United States Patent
Manchester et al.

(10) Patent No.: US 11,519,012 B2
(45) Date of Patent: Dec. 6, 2022

(54) GENOMIC ENGINEERING OF BIOSYNTHETIC PATHWAYS LEADING TO INCREASED NADPH

(71) Applicant: Zymergen Inc., Emeryville, CA (US)

(72) Inventors: Shawn Manchester, Oakland, CA (US); Benjamin Mason, Oakland, CA (US); Alexi Goranov, Oakland, CA (US)

(73) Assignee: Zymergen Inc., Emeryville, CA (US)

( * ) Notice: Subject to any disclaimer, the term of this patent is extended or adjusted under 35 U.S.C. 154(b) by 0 days.

(21) Appl. No.: 16/614,566

(22) PCT Filed: May 18, 2018

(86) PCT No.: PCT/US2018/033529
§ 371 (c)(1),
(2) Date: Nov. 18, 2019

(87) PCT Pub. No.: WO2018/213796
PCT Pub. Date: Nov. 22, 2018

(65) Prior Publication Data
US 2020/0263214 A1 Aug. 20, 2020

Related U.S. Application Data

(60) Provisional application No. 62/508,589, filed on May 19, 2017.

(51) Int. Cl.
*C12P 13/08* (2006.01)

(52) U.S. Cl.
CPC ....... *C12P 13/08* (2013.01); *C12Y 102/01011* (2013.01); *C12Y 102/01012* (2013.01);
(Continued)

(58) Field of Classification Search
None
See application file for complete search history.

(56) References Cited

U.S. PATENT DOCUMENTS

| 4,435,504 A | 3/1984 | Zuk et al. |
| 4,855,240 A | 8/1989 | Rosenstein et al. |
| (Continued) | | |

FOREIGN PATENT DOCUMENTS

| EP | 0972081 B1 | 6/2007 |
| EP | 2453006 A2 | 5/2012 |
| (Continued) | | |

OTHER PUBLICATIONS

GenBank Accession No. OLD73167.1, published Dec. 23, 2016 (Year: 2016).*

(Continued)

*Primary Examiner* — Richard C Ekstrom
(74) *Attorney, Agent, or Firm* — Cooley LLP

(57) ABSTRACT

The disclosure relates to host cells having altered NADPH availability, allowing for increased production of compounds produced using NADPH, and methods of use thereof. NADPH availability is altered by one or more of: expressing an altered GAPDH, expressing a variant glutamate dehydrogenase (gdh), aspartate semialdehyde dehydrogenase (asd), dihydropicolinate reductase (dapB), and meso-diaminopimelate dehydrogenase (ddh), expressing a novel nicotinamide nucleotide transhydrogenase, expressing a novel threonine aldolase, and expressing or modulating the expression of a pyruvate carboxylase in the host cells.

12 Claims, 22 Drawing Sheets

Specification includes a Sequence Listing.

(52) U.S. Cl.
CPC .......... *C12Y 104/01003* (2013.01); *C12Y 105/01017* (2013.01); *C12Y 401/02042* (2013.01)

(56) References Cited

U.S. PATENT DOCUMENTS

| | | | |
|---|---|---|---|
| 4,980,298 | A | 12/1990 | Blake et al. |
| 5,591,645 | A | 1/1997 | Rosenstein |
| 5,605,793 | A | 2/1997 | Stemmer |
| 5,837,458 | A | 11/1998 | Minshull et al. |
| 6,040,439 | A | 3/2000 | Hayakawa et al. |
| 6,060,296 | A | 5/2000 | Hoekstra |
| 6,090,592 | A | 7/2000 | Adams et al. |
| 6,171,833 | B1 | 1/2001 | Sinskey et al. |
| 6,300,070 | B1 | 10/2001 | Boles et al. |
| 7,115,400 | B1 | 10/2006 | Adessi et al. |
| 9,988,624 | B2 | 6/2018 | Serber et al. |
| 2007/0292918 | A1 | 12/2007 | Stelman et al. |
| 2010/0137143 | A1 | 6/2010 | Rothberg et al. |
| 2010/0216648 | A1 | 8/2010 | Staehler et al. |
| 2010/0304982 | A1 | 12/2010 | Hinz et al. |
| 2011/0172127 | A1 | 7/2011 | Jacobsen et al. |
| 2017/0051323 | A1* | 2/2017 | Ochrombel .......... C12N 9/0016 |
| 2017/0159045 | A1 | 6/2017 | Serber et al. |
| 2017/0316353 | A1 | 11/2017 | Frewen et al. |
| 2018/0362991 | A1 | 12/2018 | Serber et al. |
| 2019/0194705 | A1* | 6/2019 | Chou .......... C12N 15/52 |
| 2019/0194769 | A1* | 6/2019 | Manchester .......... C12P 13/12 |
| 2020/0263214 | A1* | 8/2020 | Manchester .......... C12P 19/36 |

FOREIGN PATENT DOCUMENTS

| | | |
|---|---|---|
| EP | 2559758 A1 | 2/2013 |
| JP | 2012532603 A | 12/2012 |
| WO | WO 2005/021772 A1 | 3/2005 |
| WO | WO 2011/080301 A2 | 7/2011 |
| WO | WO 2011/153116 A1 | 12/2011 |
| WO | WO-2011154147 A1 | 12/2011 |
| WO | WO 2017/100376 A2 | 6/2017 |
| WO | WO 2017/100377 A1 | 6/2017 |
| WO | WO-2017100376 A2 | 6/2017 |
| WO | WO 2017/189784 A1 | 11/2017 |
| WO | WO 2018/213796 A1 | 11/2018 |

OTHER PUBLICATIONS

GenBank Accession No. WP_041975350.1, published Feb. 8, 2015 (Year: 2015).*
UniProt Accession No. A0A0R2ALN4_9LACO, published Jan. 20, 2016 (Year: 2016).*
UniProt Accession No. DHAS_CORGL, published May 16, 2006 (Year: 2006).*
UniProt Accession No. DHE2_CLOSY, published Mar. 1, 1992 (Year: 1992).*
UniProt Accession No. DAPB_ECOBW, published Sep. 22, 2009 (Year: 2009).*
UniProt Accession No. DAPDH_CORGL, published Aug. 13, 1987 (Year: 1987).*
Aslandis and De Jong, "Ligation-independent cloning of PCR products (LIC-PCR)." Nucleic Acids Research (Oct. 25, 1990; 18(20): 6069-6074.
Azhayev and Antopolsky, et al., "Amide group assisted 3'-dephosphorylation of oligonucleotides synthesized on universal A-supports." Tetrahedron (Jun. 4, 2001); 57(23): 4977-4986.
Becker, et al., "Amplified Expression of Fructose 1,6-Bisphosphatase in Corynebacterium glutamicum Increases In Vivo Flux through the Pentose Phosphate Pathway and Lysine Production on Different Carbon Sources". Appl Environ Microbiol. (Dec. 2005); 71(12): 8587-8596.
Becker, et al., "From zero to hero—Design-based systems metabolic engineering of Corynebacterium glutamicum for l-lysine production". Metab Eng. (Mar. 2011); 13(2): 159-168. Epub Jan. 15, 2011.
Bentley, et al., "Accurate whole human genome seguencing using reversible terminator chemistry." Nature (2008); 456(7218): 53-59.
Bentley, et al., "Complete genome seguence of the model actinomycete Streptomyces coelicolor A3(2)". Nature (May 9, 2002); 417(6885): 141-147.
Bommareddy, et al., "A de novo NADPH generation pathway for improving lysine production of Corynebacterium glutamicum by rational design of the coenzyme specificity of glyceraldehyde 3-phosphate dehydrogenase". Metab Eng. (Sep. 2014); 25: 30-37. Epub Jun. 19, 2014.
Clermont, et al., "Determinants of coenzyme specificity in glyceraldehyde-3-phosphate dehydrogenase: Role of the acidic residue in the fingerprint region of the nucleotide binding fold". Biochemistry (Sep. 28, 1993); 32(38): 10178-10184.
Crameri, et al., "DNA shuffling of a family of genes from diverse species accelerates directed evolution." Nature (Jan. 15, 1998); 391(6664): 288-291.
Crameri, et al., "Molecular evolution of an arsenate detoxification pathway by DNA shuffling." Nature Biotechnology (May 1997); 15(5): 436-438.
Czar, et al. "Gene synthesis demystified." Trends in Biotechnology (Feb. 2009); 27(2): 63-72. Epub Dec. 26, 2008.
Dalphin, et al., "TransTerm: A database of translational signals." Nucleic Acids Research (Jan. 1, 1996); 24(1): 216-218.
Damha, et al., "An improved procedure for derivatization of controlled-pore glass beads for solid-phase oligonucleotide synthesis." Nucleic Acids Research (Jul. 11, 1990); 18(13): 3813-3821.
De Almeida, et al., "Transgenic expression of two marker genes under the control of an *Arabidopsis* rbcS promoter: Sequences encoding the Rubisco transit peptide increase expression levels." Molecular and General Genetics MGG (Jul. 1989); 218(1): 78-86.
Dong, et al., "Metabolic engineering of *Escherichia coli* and Corynebacterium glutamicum for the production of I-threonine". Biotechnol Adv. (Jan.-Feb. 2011); 29(1): 11-23. Epub Aug. 3, 2010.
Drmanac, et al., "Human genome sequencing using unchained base reads on self-assembling DNA nanoarrays." Science (Jan. 1, 2010); 327(5961): 78-81.
Eid, et al., "Real-time DNA sequencing from single polymerase molecules." Science (Jan. 2, 2009); 323(5910): 133-138. Epub Nov. 20, 2008.
Engler, Carola, et al., "A One Pot, One Step, Precision Cloning Method with High Throughput Capability." PLOS One (Nov. 2008); 3.11: e3647. Epub Nov. 5, 2008.
Fesko, et al., "Expanding the threonine aldolase toolbox for the asymmetric synthesis of tertiary α-amino acids". Appl Microbiol Biotechnol. (Nov. 2015); 99(22): 9651-9661. Epub Jul. 19, 2015.
Griffin and Engel, "An Examination by Site-Directed Mutagenesis of Putative Key Residues in the Determination of Coenzyme Specificity in Clostridial NAD+-Dependent Glutamate Dehydrogenase". Enzyme Res. (2011); 2011: 595793. Epub Aug. 16, 2011.
Jones, et al., "High level expression of introduced chimaeric genes in regenerated transformed plants." The EMBO Journal (Oct. 4, 1985); 4(10): 2411-2418.
Khanna, et al. "Identification of the template binding polypeptide in the pea chloroplast transcriptional complex." Nucleic Acids Research (Jan. 11, 1992); 20(1): 69-74.
Kildegaard, et al., "Engineering and systems-level analysis of *Saccharomyces cerevisiae* for production of 3-hydroxypropionic acid via malonyl-CoA reductase-dependent pathway". Microb Cell Fact. (Mar. 15, 2016); 15: 53.
Kim, et al., "Polony multiplex analysis of gene expression (PMAGE) in mouse hypertrophic cardiomyopathy." Science (Jun. 8, 2007); 316(5830): 1481-1484.
Kondo, et al., "Cloning and nucleotide sequence of Bacillus stearothermophilus pyruvate carboxylase". Gene (May 20, 1997); 191 (1): 47-50.
Kotera and Nagai, "A high-throughput and single-tube recombination of crude PCR products using a DNA polymerase inhibitor and type IIS restriction enzyme." Journal of Biotechnology (Oct. 10, 2008); 137.1: 1-7. Epub Jul. 23, 2008.
Kozlov, et al., "Significant improvement of quality for long oligonucleotides by using controlled pore glass with large pores." Nucleosides, Nucleotides and Nucleic Acids (2005); 24(5-7): 1037-1041.

(56) References Cited

OTHER PUBLICATIONS

Lee, et al., "Systems metabolic engineering of *Escherichia coli* for L-threonine production". Mol Syst Biol. (2007); 3: 149, pp. 1-7. Epub Dec. 4, 2007.

Lilley, et al., "The partial amino acid sequence of the NAD-dependent glutamate dehydrogenase of Clostridium symbiosum: implications for the evolution and structural basis of coenzyme specificity", Biochimica et Biophysica Acta (BBA)—Protein Structure and Molecular Enzymology (Nov. 15, 1991); 1080(3): 191-197.

Liu, et al., "Gene cloning, biochemical characterization and physiological role of a thermostable low-specificity L-threonine aldolase from *Escherichia coli*". Eur J Biochem. (Jul. 1, 1998); 255(1): 220-226.

Margulies, et al., "Genome sequencing in microfabricated high-density picolitre reactors." Nature (Sep. 15, 2005); 437(7057): 376-380. Epub Jul. 31, 2005.

Moore, J.C., et al., "Strategies for the in vitro evolution of protein function: enzyme evolution by random recombination of improved sequences." Journal of Molecular Biology (Sep. 26, 1997); 272(3)3: 336-347.

Mukhopadhyay, et al., "Purification, Regulation, and Molecular and Biochemical Characterization of Pyruvate Carboxylase from Methanobacterium thermoautotrophicum Strain ΔH". J. Biol. Chem. (1998); 273(9): 5155-5166.

Murray, et al., "Codon usage in plant genes." Nucleic Acids Research (Jan. 25, 1989); 17(2): 477-498.

Nakashima and Miyazaki, "Bacterial cellular engineering by genome editing and gene silencing." International Journal of Molecular Sciences (Feb. 18, 2014); 15(2): 2773-2793.

Paek, et al., "Development of rapid one-step immunochromatographic assay." Methods (Sep. 2000); 22(1): 53-60.

Payne and Morris, "Pyruvate carboxylase in Rhodopseudomonas spheroides." J Gen Microbiol. (Nov. 1969); 59(1): 97-101.

PCT/US2018/033529, International Preliminary Report on Patentability dated Nov. 19, 2019, 19 pages.

PCT/US2018/033529, International Search Report and Written Opinion dated Oct. 8, 2018, 32 pages.

PCT/US2018/033529, Invitation to Pay Additional Fees, dated Jul. 23, 2018, 22 pages.

Reddy, et al., "Expression, Purification, and Characterization of *Escherichia coli* Dihydrodipicolinate Reductase". Biochemistry (1995); 34(11): 3492-3501.

Reyrat, et al., "Counterselectable markers: untapped tools for bacterial genetics and pathogenesis." Infection and Immunity (Sep. 1998); 66(9): 4011-4017.

Ricciardelli, et al., "Development and characterization of primary cultures of smooth muscle cells from the fibromuscular stroma of the guinea pig prostate." In Vitro Cellular & Developmental Biology (Nov. 1989); 25(11): 1016-1024.

Rinchik, E.M., "Chemical mutagenesis and fine-structure functional analysis of the mouse genome". Trends Genet. (Jan. 1991); 7(1): 15-21, abstract.

Sagong and Kim, "Structural Insight into Dihydrodipicolinate Reductase from Corybebacterium glutamicum for Lysine Biosynthesis". J Microbiol Biotechnol. (Feb. 2016); 26(2): 226-232.

Schiefelbein, S., "Improved L-Lysine Production in corynebacterium glutamicum by Rational Strain Engineering", Dissertation, Universitat des Saarlandes, Saarbrucken, 2014, Jan. 1, 2014 (Jan. 1, 2014), pp. 1-130, XP055510895, Retrieved from the Internet: URL:https://publikationen.sulb.uni-saarland.de/bitstream/20.500.11880/23095/1/Dissertation_Sarah_Schiefelbein.pdf [retrieved on Sep. 28, 2018] pp. 60-75.

Sierzchala, et al., "Solid-phase oligodeoxynucleotide synthesis: a two-step cycle using peroxy anion deprotection." Journal of the American Chemical Society (Nov. 5, 2003); 125(44): 13427-13441.

Simic, et al., "Identification of glyA (Encoding Serine Hydroxymethyltransferase) and Its Use Together with the Exporter ThrE to Increase I-Threonine Accumulation by Corynebacterium glutamicum". Appl Environ Microbiol. (Jul. 2002); 68(7): 3321-3327.

Stemmer, W.P., "DNA shuffling by random fragmentation and reassembly: In vitro recombination for molecular evolution." Proceedings of the National Academy of Sciences (Oct. 25, 1994); 91(22): 10747-10751.

Stemmer, W.P., "Rapid evolution of a protein in vitro by DNA shuffling." Nature (Aug. 4, 1994); 370(6488): 389-391.

Su, et al., "*Escherichia coli* mutS-encoded protein binds to mismatched DNA base pairs." Proceedings of the National Academy of Sciences (Jul. 15, 1986); 83(14): 5057-5061.

Takeno, et al., "Engineering of Corynebacterium glutamicum with an NADPH-Generating Glycolytic Pathway for I-Lysine Production". Appl Environ Microbiol. (Nov. 2010); 76(21): 7154-7160. Epub Sep. 17, 2010.

Tear, et al., "Excision of Unstable Artificial Gene-Specific Inverted Repeats Mediates Scar-Free Gene Deletions in *Escherichia coli*." Applied Biochemistry and Biotechnology (Feb. 2015); 175(4): 1858-1867. Epub Nov. 27, 2014.

Tian, et al., "Advancing high-throughput gene synthesis technology." Molecular BioSystems (Jul. 2009); 5(7): 714-722. Epub Apr. 6, 2009.

Tosaka, et al., "The Role of Biotin-Dependent Pyruvate Carboxylase in I-Lysine Production". Agricultural and Biological Chemistry (1979); 43(7): 1513-1519.

Vallino and Stephanopoulos, "Metabolic flux distributions in Corynebacterium glutamicum during growth and lysine overproduction". Biotechnol. Bioeng. (1993); 41: 633-646.

Verho, et al., "Engineering Redox Cofactor Regeneration for Improved Pentose Fermentation in *Saccharomyces cerevisiae*". Appl Environ Microbiol. (Oct. 2003); 69(10): 5892-5897.

Wagner, et al., "Mutation detection using immobilized mismatch binding protein (MutS)." Nucleic Acids Research (Oct. 11, 1995); 23(19): 3944-3948.

Weber, et al., "Assembly of designer TAL effectors by Golden Gate cloning." PLOS One (2011); 6.5: e19722. Epub May 19, 2011.

Xu, et al., "Metabolic engineering Corynebacterium glutamicum for the I-lysine production by increasing the flux into I-lysine biosynthetic pathway". Amino Acids (Sep. 2014); 46(9): 2165-2175. Epub May 31, 2014.

Xu, et al., "Modification of aspartokinase III and dihydrodipicolinate synthetase increases the production of I-lysine in *Escherichia coli*", Biochemical Engineering Journal (Oct. 15, 2016); 114: 79-86.

Xu, et al., "Mutagenesis of Key Residues in the Binding Center of I-Aspartate-β-Semialdehyde Dehydrogenase from *Escherichia coli* Enhances Utilization of the Cofactor NAD(H)". Chembiochem (2016); 17(1): 56-64. Epub Dec. 10, 2015.

Zhang, et al., "Directed evolution of a fucosidase from a galactosidase by DNA shuffling and screening." Proc Natl Acad Sci U S A. (1997); 94 (9): 4504-4509.

Becker and Guarente, "[12] High-efficiency transformation of yeast by electroporation." Methods in Enzymology (Jan. 1, 1991); 194: 182-187.

Malumbres and Martn, "Molecular control mechanisms of lysine and threonine biosynthesis in amino acid-producing corynebacteria: Redirecting carbon flow". FEMS Microbiol Lett. (Oct. 1, 1996); 143(2-3): 103-114.

* cited by examiner

GENOMIC ENGINEERING OF BIOSYNTHETIC PATHWAYS LEADING TO INCREASED NADPH

CROSS-REFERENCE TO RELATED APPLICATIONS

This application is a national phase filing under 35 U.S.C. § 371 of International Patent Application No. PCT/US2018/033529, filed on May 18, 2018, which claims the benefit of priority to U.S. Provisional Application No. 62/508,589, filed on May 19, 2017, the disclosures of which are incorporated by reference in their entireties for all purposes.

STATEMENT REGARDING SEQUENCE LISTING

The Sequence Listing associated with this application is provided in text format in lieu of a paper copy, and is hereby incorporated by reference into the specification. The name of the text file containing the Sequence Listing is ZYMR_011_01WO_SeqList_ST25.txt. The text file is 950 KB, was created on May 18, 2018, and is being submitted electronically via EFS-Web.

FIELD

The disclosure is directed generally to microbial engineering methods that increase NADPH availability in a microbial cell.

In particular, the disclosure relates to engineering host cell to increase NADPH availability by expressing one or more of an altered GAPDH, a variant glutamate dehydrogenase (gdh), aspartate semialdehyde dehydrogenase (asd), dihydropicolinate reductase (dapB), meso-diaminopimelate dehydrogenase (ddh), threonine aldohase (ltaE), pyruvate carboxylase (pyc), and a novel nicotinamide nucleotide transhydrogenase in the host cells.

BACKGROUND

NADPH as a reducing equivalent is involved in many important bioprocesses for the synthesis of industrially important compounds, such as sugars and amino acids such as L-lysine and L-threonine. However, it is known that the normal cellular supply of NADPH can be a limiting factor in the production of compounds produced using NADPH. For example, NADPH can be a limiting factor when producing L-lysine in an industrial scale in *C. glutamicum* (Becker et al. (2005), *Appl. Environ. Microbiol.*, 71(12): 8587-8596).

Thus, there is a great need in the art for new methods of engineering industrial microbes for overcoming limits on the availability of NADPH in cells used to produce compounds made using NADPH, such as cells used to produce L-lysine or L-threonine.

SUMMARY OF THE DISCLOSURE

The present disclosure relates to at least six strategies to overcome limits on NADPH availability in host cells, which leads to increased L-lysine, L-threonine, L-isoleucine, L-methionine, or L-glycine production: (1) engineering the glycolytic pathway to produce NADPH by broadening the coenzyme specificity of the endogenous glycolytic enzyme Glyceraldehyde-3-phosphate dehydrogenase (gapA) such that the enzyme possesses dual specificity for NADP and NAD; (2) expressing a transhydrogenase enzyme in the host cell that generates NADPH from NADH; (3) reprogramming the DAP-pathway for lysine synthesis by expressing homologues of the endogenous gdh, asd, dapB and ddh enzymes, that use NADH more effectively than NADPH as a cofactor; (4) reprogramming the thrABC-pathway for threonine synthesis by expressing homologues of the endogenous gdh and asd enzymes, that use NADH more effectively than NADPH as a cofactor; (5) reprogramming threonine synthesis by expressing homologues of the endogenous L-threonine aldohase (ltA) that decrease or reverse degradation of threonine to glycine; and (6) expressing a heterologous pyruvate carboxylase (pyc) or homologues thereof to increase synthesis of oxaloacetate, or increasing expression of an endogenous pyc.

In certain embodiments is provided a method of improving a host cell's ability to produce a compound produced using NADPH, the method comprising altering the cell's available NADPH.

In certain embodiments is provided a host cell comprising a modified GAPDH having a broadened coenzyme specificity relative to a naturally existing GAPDH, wherein the host cell has improved production of a compound produced using NADPH relative to a counterpart host cell which lacks the modified GAPDH.

In certain embodiments is provided a method of producing L-lysine, comprising culturing a *Corynebacterium* sp. strain and recovering L-lysine from the cultured *Corynebacterium* sp. strain or the culture broth, wherein the *Corynebacterium* sp. strain expresses a modified GAPDH that uses NADP as a coenzyme, and wherein the *Corynebacterium* sp. strain has an improved productivity of L-lysine.

In certain embodiments is provided a method of broadening the coenzyme specificity of GAPDH comprising: modifying the GAPDH such that the modified GAPDH has dual specificity for coenzymes NADP and NAD.

In certain embodiments is provided a method of improving efficiency of production of a compound produced using NADPH by a host cell, comprising: expressing, in the host cell, a variant enzyme of one or more of the enzymes glutamate dehydrogenase (gdh), aspartate semialdehyde dehydrogenase (asd), dihydropicolinate reductase (dapB), and meso-diaminopimelate dehydrogenase (ddh), wherein the variant enzyme exhibits dual specificity for coenzymes NADH and NADPH.

In certain embodiments is provided a host cell comprising: a variant of one or more enzymes gdh, asd, dapB, and ddh, wherein the variant exhibits dual specificity for coenzymes NADH and NADPH.

In certain embodiments is provided a method of improving efficiency of production of a compound produced using NADPH by a host cell, comprising expressing, in the host cell, a novel nicotinamide nucleotide transhydrogenase.

In certain embodiments is provided a method of improving efficiency of L-lysine production by a host cell, comprising two or more of the following:
modifying an endogenous GAPDH such that the modified GAPDH has an increased specificity to coenzyme NADP relative to the corresponding naturally occurring GAPDH;
expressing, in the host cell, a variant enzyme of one or more of the enzymes glutamate dehydrogenase (gdh), aspartate semialdehyde dehydrogenase (asd), dihydropicolinate reductase (dapB), and meso-diaminopimelate dehydrogenase (ddh), wherein the variant enzyme exhibits dual specificity for coenzymes NADH and NADPH; and expressing, in the host cell, a novel nicotinamide nucleotide transhydrogenase.

In certain embodiments is provided a method of improving efficiency of production of a compound produced using NADPH by a host cell, comprising: expressing, in the host cell, a variant enzyme of one or both of the enzymes glutamate dehydrogenase (gdh) and aspartate semialdehyde dehydrogenase (asd), wherein the variant enzyme exhibits dual specificity for coenzymes NADH and NADPH.

In certain embodiments is provided a method of improving efficiency of production of L-threonine by a host cell, comprising: expressing, in the host cell, a variant enzyme of threonine aldolase, wherein the variant enzyme exhibits substrate preference or enzyme kinetics different from *E. coli* threonine aldolase (ltaE).

In certain embodiments is provided a method of increasing L-threonine production by a host cell, comprising: expressing, in the host cell, a variant enzyme of one or more of the enzymes glyceraldehyde 3-phosphate dehydrogenase (gapA), glutamate dehydrogenase (gdh), aspartate semialdehyde dehydrogenase (asd), threonine aldolase (ltaE), and pyruvate carboxylase (pyc).

In certain embodiments is provided a host cell comprising a multi-copy replicating plasmid comprising a thrA gene, a thrB gene, and a thrC gene each operatively linked to one or more synthetic promoters.

In certain embodiments is provided a method of improving efficiency of production of a compound by a host cell, comprising two or more of the following: (1) engineering the glycolytic pathway to produce NADPH by broadening the coenzyme specificity of the endogenous glycolytic enzyme Glyceraldehyde-3-phosphate dehydrogenase (gapA) such that the enzyme possesses dual specificity for NADP and NAD; (2) expressing a transhydrogenase enzyme in the host cell that generates NADPH from NADH; (3) reprogramming the DAP-pathway for lysine synthesis by expressing homologues of the endogenous gdh, asd, dapB and ddh enzymes, that use NADH more effectively than NADPH as a cofactor; (4) reprogramming the thrABC-pathway for threonine synthesis by expressing homologues of the endogenous gdh and asd enzymes, that use NADH more effectively than NADPH as a cofactor; (5) reprogramming threonine synthesis by expressing homologues of the endogenous L-threonine aldohase (ltA) that decrease or reverse degradation of threonine to glycine; and (6) expressing a heterologous pyruvate carboxylase (pyc) or homologues thereof to increase synthesis of oxaloacetate, or increasing expression of an endogenous pyc.

In certain embodiments is provided an artificial polynucleotide encoding a truncated glyceraldehyde-3-phosphate dehydrogenase (gapA) gene, wherein the polynucleotide comprises a sequence at least 85%, 90%, 95%, or 99% identical to a polynucleotide sequence selected from the group consisting of SEQ ID NO: 290, 291, 292, and 293.

In certain embodiments is provided a recombinant protein fragment of glyceraldehyde-3-phosphate dehydrogenase (gapA), wherein the recombinant protein fragment comprises a sequence at least 70%, 80%, 90%, or 95% identical to an amino acid sequence selected from the group consisting of SEQ ID NO: 233, 234, 235, 236, and 298.

In certain embodiments is provided a method of improving efficiency of L-lysine or L-threonine production by a host cell comprising increasing the ability of the host cell to produce NADPH. In some aspects, the method comprises modifying Glyceraldehyde-3-phosphate dehydrogenase (GAPDH) such that its coenzyme specificity is broadened. In certain cases, the modified GAPDH has an increased specificity to coenzyme NADP relative to the corresponding naturally occurring GAPDH. In certain aspects, the host cell is a prokaryotic cell. In certain aspects, the host cell is *Corynebacterium* sp. In some aspects, the host cell is *Corynebacterium glutamicum*. In some embodiments, the host cell is *Escherichia coli*. In some embodiments, the naturally occurring GAPDH has an amino acid sequence of SEQ ID NO:58. In some aspects, the modified GAPDH comprises an amino acid sequence that is at least 95% identical to the amino acid sequence of SEQ ID NO:58. In certain embodiments, the modified GAPDH comprises an amino acid replacement in a position that corresponds to amino acid 37 of SEQ ID NO:58. In other embodiments, the modified GAPDH comprises amino acid replacements in positions that correspond to amino acids 36 and 37 of SEQ ID NO:58. In certain aspects, the Threonine in the position that corresponds to amino acid 37 of SEQ ID NO:58 has been replaced by Lysine. In other aspects, the Leucine in the position that corresponds to amino acid 36 of SEQ ID NO:58 has been replaced by Threonine, and the Threonine in the position that corresponds to amino acid 37 of SEQ ID NO:58 has been replaced by Lysine.

In certain embodiments is provided a method of improving efficiency of L-lysine production by a host cell comprising decreasing the ability of the host cell to utilize NADPH comprising expressing, in the host cell, a variant enzyme of one or more of the enzymes glutamate dehydrogenase (gdh), aspartate semialdehyde dehydrogenase (asd), dihydropicolinate reductase (dapB), and meso-diaminopimelate dehydrogenase (ddh), wherein the variant enzyme exhibits dual specificity for coenzymes NADH and NADPH. In certain aspects, all four enzymes are expressed simultaneously in the host cell. In certain embodiments is provided a method of improving efficiency of L-threonine production by a host cell comprising decreasing the ability of the host cell to utilize NADPH comprising expressing, in the host cell, a variant enzyme of either or both of the enzymes glutamate dehydrogenase (gdh) and aspartate semialdehyde dehydrogenase (asd), wherein the variant enzyme exhibits dual specificity for coenzymes NADH and NADPH. In some embodiments, the variant enzyme uses NADH more effectively than NADPH. In certain embodiments, the method comprises expressing a variant enzyme of gdh, wherein the variant enzyme comprises an amino acid sequence that is at least about 70%, 75%, 80%, 85%, 90%, 95%, or 100% identical to the amino acid sequence of SEQ ID NO:42. In certain aspects, the method comprises expressing a variant enzyme of gdh, wherein the variant enzyme comprises an amino acid sequence that is at least about 95% identical to the amino acid sequence of SEQ ID NO:42. In other embodiments, the method comprises expressing a variant enzyme of asd, wherein the variant enzyme comprises an amino acid sequence that is at least about 70%, 75%, 80%, 85%, 90%, 95%, or 100% identical to the amino acid sequence of SEQ ID NO:40. In other aspects, the method comprises expressing a variant enzyme of asd, wherein the variant enzyme comprises an amino acid sequence that is at least 95% identical to the amino acid sequence of SEQ ID NO:40. In yet other aspects, the method comprises expressing a variant enzyme of dapB, wherein the variant enzyme comprises an amino acid sequence that is at least 95% identical to the amino acid sequence of SEQ ID NO:46. In still other aspects, the method comprises expressing a variant enzyme of ddh, wherein the ddh enzyme comprises an amino acid sequence of SEQ ID NO:4. In certain embodiments, the variant enzyme of gdh comprises an amino acid sequence of SEQ ID NO:44. In other embodiments, the variant enzyme of asd comprises an amino acid sequence of SEQ ID NO:30. In yet other embodiments, the variant enzyme of dapB comprises an amino acid sequence of SEQ ID NO:48.

In other embodiments is provided a method of producing L-lysine or L-threonine, comprising culturing a *Corynebacterium* sp. or *Escherichia coli* strain and recovering L-lysine or L-threonine from the cultured *Corynebacterium* sp. or *Escherichia coli* strain or the culture broth, wherein the *Corynebacterium* sp. or *Escherichia coli* strain expresses a modified GAPDH that uses NADP as a coenzyme, and wherein the *Corynebacterium* sp. or *Escherichia coli* strain has an improved productivity of L-lysine or L-threonine.

In yet other embodiments is provided a method of broadening the coenzyme specificity of GAPDH by modifying the GAPDH, wherein the modified GAPDH has dual specificity for coenzymes NADP and NAD. In certain aspects, the modified GAPDH has an increased specificity to coenzyme NADP relative to NAD. In other aspects, the modified GAPDH uses NADP more effectively than NAD.

In some embodiments is provided a host cell comprising a modified GAPDH, wherein the modified GAPDH comprises an amino acid sequence that is at least 95% identical to the amino acid sequence of SEQ ID NO:58, and wherein the threonine in the position that corresponds to amino acid 37 of SEQ ID NO:58 has been replaced by lysine. In certain aspects, the host cell is *C. glutamicum*.

In other embodiments is provided a host cell comprising a modified GAPDH, wherein the modified GAPDH comprises an amino acid sequence that is at least 95% identical to the amino acid sequence of SEQ ID NO:58, and wherein the leucine in the position that corresponds to amino acid 36 of SEQ ID NO:58 has been replaced by threonine, and the threonine in the position that corresponds to amino acid 37 of SEQ ID NO:58 has been replaced by lysine. In certain aspects, the host cell is *C. glutamicum*.

In further embodiments is provided a host cell comprising a variant of one or more enzymes gdh, asd, dapB, and ddh, wherein the variant exhibits dual specificity for coenzymes NADH and NADPH.

In some embodiments, the present disclosure teaches a method of improving a host cell's ability to produce a compound produced using NADPH, the method comprising altering the cell's available NADPH.

In some embodiments, the present disclosure teaches a method of improving a host cell's ability to produce a compound produced using wherein the available NADPH is altered by expressing a modified Glyceraldehyde-3-phosphate dehydrogenase (GAPDH) in the cell, wherein the modified GAPDH is modified such that its coenzyme specificity is broadened.

In some embodiments, the present disclosure teaches a method of improving a host cell's ability to produce a compound produced using NADPH, wherein the modified GAPDH has an increased specificity to coenzyme NADP relative to the corresponding naturally occurring GAPDH.

In some embodiments, the present disclosure teaches a method of improving a host cell's ability to produce a compound produced using NADPH, wherein the host cell is *Corynebacterium* sp.

In some embodiments, the present disclosure teaches a method of improving a host cell's ability to produce a compound produced using NADPH, wherein the host cell is *Corynebacterium glutamicum*.

In some embodiments, the present disclosure teaches a method of improving a host cell's ability to produce a compound produced using NADPH, wherein the naturally occurring GAPDH is gapA.

In some embodiments, the present disclosure teaches a method of improving a host cell's ability to produce a compound produced using NADPH, wherein the gapA has an amino acid sequence of SEQ ID NO:58.

In some embodiments, the present disclosure teaches a method of improving a host cell's ability to produce a compound produced using NADPH, wherein the modified GAPDH comprises an amino acid sequence that is at least 95% identical to the amino acid sequence of SEQ ID NO:58.

In some embodiments, the present disclosure teaches a method of improving a host cell's ability to produce a compound produced using NADPH, wherein the modified GAPDH comprises an amino acid replacement in a position that corresponds to amino acid 37 of SEQ ID NO:58.

In some embodiments, the present disclosure teaches a method of improving a host cell's ability to produce a compound produced using NADPH, wherein the modified GAPDH comprises amino acid replacements in positions that correspond to amino acids 36 and 37 of SEQ ID NO:58.

In some embodiments, the present disclosure teaches a method of improving a host cell's ability to produce a compound produced using NADPH, wherein the threonine in the position that corresponds to amino acid 37 of SEQ ID NO:58 has been replaced by lysine.

In some embodiments, the present disclosure teaches a method of improving a host cell's ability to produce a compound produced using NADPH, wherein the leucine in the position that corresponds to amino acid 36 of SEQ ID NO:58 has been replaced by threonine, and the threonine in the position that corresponds to amino acid 37 of SEQ ID NO:58 has been replaced by lysine.

In some embodiments, the present disclosure teaches a method of improving a host cell's ability to produce a compound produced using NADPH, wherein the compound is selected from the group consisting of: a polyketide (such as pikromycin, erythromycin A, clarithromycin, azithromycin, Avermectin, ivermectin, spinosad, geldanamycin, macbecin, rifamycin, amphotericin, nystatin, pimaricin, monensin, doxycycline, bullatacin, squamocin, molvizarin, uvaricin, annonacin, tacrolimus, sirolimus, radicicol, lovastatin, discodermolide, aflatoxin, usnic acid, and anthramycin); a Catechin (such as epicatechin, epigallocatechin, epicatechin gallate, epigallocatechin gallate, epiafzelechin, fisetinidol, guibourtinidol, mesquitol, and robinetinidol); a terpene (such as prenol, isovaleric acid, geraniol, terpineol, limonene, myrcene, linalool, pinene, humulene, farnesenes, farnesol, cafestol, kahweol, cembrene, taxadiene, retinol, retinal, phytol, geranylfarnesol, squalene, lanosterol, cycloartenol, cholesterol, ferrugicadiol, tetraprenylcurcumene, lycopene, gamma-carotene, alpha- and beta-carotenes, 3-oxo-α-ionol, 7,8-dihydroionone, megastigmane-3,9-diol, and 3-oxo-7,8-dihydro-α-ionol); a fatty acid (such as myristoleic acid, palmitoleic acid, sapienic acid, oleic acid, elaidic acid, vaccenic acid, linoleic acid, linoelaidic acid, α-linolenic acid, arachidonic acid, eicosapentaenoic acid, erucic acid, docosahexaenoic acid, caprylic acid, capric acid, lauric acid, myristic acid, palmitic acid, stearic acid, arachidic acid, behenic acid, lignoceric acid, and cerotic acid); an amino acid or derivative thereof (such as S-adenosyl methionine, isoleucine, leucine, valine, methionine, threonine, lysine, glutamate, tryptophan, tyrosine, L-lysine, and phenylalanine); a compound from the chorismate pathway (such as Indole, chorismate, shikimate, salicylic acid, 2,3-dihydroxybenzoic acid, para-aminobenzoate, vitamin k, and folate); and an alkaloid (such as ephedrine, homoharringtonine, galantamine, vincamine, quinidine, morphine, chelerythrine, piperine, caffeine, nicotine, theobromine, and quinine).

In some embodiments, the present disclosure teaches a method of improving a host cell's ability to produce a compound produced using NADPH, wherein the compound is selected from Table 2.

In some embodiments, the present disclosure teaches a host cell comprising a modified GAPDH having a broadened coenzyme specificity relative to a naturally existing GAPDH, wherein the host cell has improved production of a compound produced using NADPH relative to a counterpart host cell which lacks the modified GAPDH.

In some embodiments, the present disclosure teaches a host cell comprising a modified GAPDH having a broadened coenzyme specificity relative to a naturally existing GAPDH, wherein the modified GAPDH has increased specificity to NADP relative to the naturally existing GAPDH.

In some embodiments, the present disclosure teaches a host cell comprising a modified GAPDH having a broadened coenzyme specificity relative to a naturally existing GAPDH, wherein the modified GAPDH comprises an amino acid sequence which is at least 95% identical to SEQ ID NO: 58, In some embodiments, the present disclosure teaches a host cell comprising a modified GAPDH having a broadened coenzyme specificity relative to a naturally existing GAPDH, wherein the modified GAPDH comprises an amino acid sequence which is at least 70% identical to SEQ ID NO: 58 and wherein the modified GAPDH comprises substitutions for the amino acids at positions 36, 37, or both of SEQ ID NO: 58.

In some embodiments, the present disclosure teaches a host cell comprising a modified GAPDH having a broadened coenzyme specificity relative to a naturally existing GAPDH, wherein the compound is selected from the group consisting of: a polyketide (such as pikromycin, erythromycin A, clarithromycin, azithromycin, Avermectin, ivermectin, spinosad, geldanamycin, macbecin, rifamycin, amphotericin, nystatin, pimaricin, monensin, doxycycline, bullatacin, squamocin, molvizarin, uvaricin, annonacin, tacrolimus, sirolimus, radicicol, lovastatin, discodermolide, aflatoxin, usnic acid, and anthramycin); a Catechin (such as epicatechin, epigallocatechin, epicatechin gallate, epigallocatechin gallate, epiafzelechin, fisetinidol, guibourtinidol, mesquitol, and robinetinidol); a terpene (such as prenol, isovaleric acid, geraniol, terpineol, limonene, myrcene, linalool, pinene, humulene, farnesenes, farnesol, cafestol, kahweol, cembrene, taxadiene, retinol, retinal, phytol, geranylfarnesol, squalene, lanosterol, cycloartenol, cholesterol, ferrugicadiol, tetraprenylcurcumene, lycopene, gamma-carotene, alpha- and beta-carotenes, 3-oxo-α-ionol, 7,8-dihydroionone, megastigmane-3,9-diol, and 3-oxo-7,8-dihydro-α-ionol); a fatty acid (such as myristoleic acid, palmitoleic acid, sapienic acid, oleic acid, elaidic acid, vaccenic acid, linoleic acid, linoelaidic acid, α-linolenic acid, arachidonic acid, eicosapentaenoic acid, erucic acid, docosahexaenoic acid, caprylic acid, capric acid, lauric acid, myristic acid, palmitic acid, stearic acid, arachidic acid, behenic acid, lignoceric acid, and cerotic acid); an amino acid or derivative thereof (such as S-adenosyl methionine, isoleucine, leucine, valine, methionine, threonine, lysine, glutamate, tryptophan, tyrosine, L-lysine, and phenylalanine); a compound from the chorismate pathway (such as Indole, chorismate, shikimate, salicylic acid, 2,3-dihydroxy-benzoic acid, para-aminobenzoate, vitamin k, and folate); and an alkaloid (such as ephedrine, homoharringtonine, galantamine, vincamine, quinidine, morphine, chelerythrine, piperine, caffeine, nicotine, theobromine, and quinine).

In some embodiments, the present disclosure teaches a host cell comprising a modified GAPDH having a broadened coenzyme specificity relative to a naturally existing GAPDH, wherein the compound is selected from Table 2.

In some embodiments, the present disclosure teaches a host cell comprising a modified GAPDH having a broadened coenzyme specificity relative to a naturally existing GAPDH wherein the modification comprises a replacement of the leucine in the position that corresponds to amino acid 36 of SEQ ID NO:58 by threonine, and the replacement of the threonine in the position that corresponds to amino acid 37 of SEQ ID NO:58 by lysine.

In some embodiments, the present disclosure teaches a host cell comprising a modified GAPDH having a broadened coenzyme specificity relative to a naturally existing GAPDH, wherein the host cell is *C. glutamicum*.

In some embodiments, the present disclosure teaches a method of producing L-lysine, comprising culturing a *Corynebacterium* sp. strain and recovering L-lysine from the cultured *Corynebacterium* sp. strain or the culture broth, wherein the *Corynebacterium* sp. strain expresses a modified GAPDH that uses NADP as a coenzyme, and wherein the *Corynebacterium* sp. strain has an improved productivity of L-lysine.

In some embodiments, the present disclosure teaches a method of broadening the coenzyme specificity of GAPDH comprising: modifying the GAPDH such that the modified GAPDH has dual specificity for coenzymes NADP and NAD.

In some embodiments, the present disclosure teaches a method of broadening the coenzyme specificity of GAPDH comprising: modifying the GAPDH such that the modified GAPDH has dual specificity for coenzymes NADP and NAD, wherein the modified GAPDH has an increased specificity to coenzyme NADP relative to NAD.

In some embodiments, the present disclosure teaches a method of broadening the coenzyme specificity of GAPDH comprising: modifying the GAPDH such that the modified GAPDH has dual specificity for coenzymes NADP and NAD, wherein the modified GAPDH uses NADP more effectively than NAD.

In some embodiments the present disclosure teaches a method of improving efficiency of production of a compound produced using NADPH by a host cell, comprising: expressing, in the host cell, a variant enzyme of one or more of the enzymes glutamate dehydrogenase (gdh), aspartate semialdehyde dehydrogenase (asd), dihydropicolinate reductase (dapB), and meso-diaminopimelate dehydrogenase (ddh), wherein the variant enzyme exhibits dual specificity for coenzymes NADH and NADPH.

In some embodiments the present disclosure teaches a method of improving efficiency of production of a compound produced using NADPH by a host cell, comprising: expressing, in the host cell, a variant enzyme of one or more of the enzymes glutamate dehydrogenase (gdh), aspartate semialdehyde dehydrogenase (asd), dihydropicolinate reductase (dapB), and meso-diaminopimelate dehydrogenase (ddh), wherein the variant enzyme exhibits dual specificity for coenzymes NADH and NADPH, wherein the compound is selected from: a polyketide (such as pikromycin, erythromycin A, clarithromycin, azithromycin, Avermectin, ivermectin, spinosad, geldanamycin, macbecin, rifamycin, amphotericin, nystatin, pimaricin, monensin, doxycycline, bullatacin, squamocin, molvizarin, uvaricin, annonacin, tacrolimus, sirolimus, radicicol, lovastatin, discodermolide, aflatoxin, usnic acid, and anthramycin); a Catechin (such as epicatechin, epigallocatechin, epicatechin gallate, epigallocatechin gallate, epiafzelechin, fisetinidol, guibourtinidol, mesquitol, and robinetinidol); a terpene (such as prenol, isovaleric acid, geraniol, terpineol, limonene, myrcene, linalool, pinene, humulene, farnesenes, farnesol, cafestol, kahweol, cembrene, taxadiene, retinol, retinal, phytol, geranylfarnesol, squalene, lanosterol, cycloartenol, cholesterol, ferrugicadiol, tetraprenylcurcumene, lycopene, gamma-carotene, alpha- and beta-carotenes, 3-oxo-α-ionol, 7,8-dihydroionone, megastigmane-3,9-diol, and 3-oxo-7,8-dihydro-α-ionol); a fatty acid (such as myristoleic acid, palmitoleic acid, sapienic acid, oleic acid, elaidic acid, vaccenic acid, linoleic acid, linoelaidic acid, α-linolenic acid, arachidonic acid, eicosapentaenoic acid, erucic acid, docosahexaenoic acid, caprylic acid, capric acid, lauric acid, myristic acid, palmitic acid, stearic acid, arachidic acid, behenic acid, lignoceric acid, and cerotic acid); an amino acid or derivative thereof (such as S-adenosyl methionine, isoleucine, leucine, valine, methionine, threonine, lysine, glutamate, tryptophan, tyrosine, L-lysine, and phenylalanine); a compound from the chorismate pathway (such as Indole, chorismate, shikimate, salicylic acid, 2,3-dihydroxybenzoic acid, para-aminobenzoate, vitamin k, and folate); and an alkaloid (such as ephedrine, homoharringtonine, galantamine, vincamine, quinidine, morphine, chelerythrine, piperine, caffeine, nicotine, theobromine, and quinine).

In some embodiments the present disclosure teaches a method of improving efficiency of production of a compound produced using NADPH by a host cell, comprising: expressing, in the host cell, a variant enzyme of one or more of the enzymes glutamate dehydrogenase (gdh), aspartate semialdehyde dehydrogenase (asd), dihydropicolinate reductase (dapB), and meso-diaminopimelate dehydrogenase (ddh), wherein the variant enzyme exhibits dual specificity for coenzymes NADH and NADPH, wherein the compound is selected from Table 2.

In some embodiments the present disclosure teaches a method of improving efficiency of production of a compound produced using NADPH by a host cell, comprising: expressing, in the host cell, a variant enzyme of one or more of the enzymes glutamate dehydrogenase (gdh), aspartate semialdehyde dehydrogenase (asd), dihydropicolinate reductase (dapB), and meso-diaminopimelate dehydrogenase (ddh), wherein the variant enzyme exhibits dual specificity for coenzymes NADH and NADPH, wherein the variant enzyme uses NADH more effectively than NADPH.

In some embodiments the present disclosure teaches a method of improving efficiency of production of a compound produced using NADPH by a host cell, comprising: expressing, in the host cell, a variant enzyme of one or more of the enzymes glutamate dehydrogenase (gdh), aspartate semialdehyde dehydrogenase (asd), dihydropicolinate reductase (dapB), and meso-diaminopimelate dehydrogenase (ddh), wherein the variant enzyme exhibits dual specificity for coenzymes NADH and NADPH, wherein the method comprises expressing a variant enzyme of gdh, wherein the variant enzyme comprises an amino acid sequence that is at least 95% identical to the amino acid sequence of SEQ ID NO:42.

In some embodiments the present disclosure teaches a method of improving efficiency of production of a compound produced using NADPH by a host cell, comprising: expressing, in the host cell, a variant enzyme of one or more of the enzymes glutamate dehydrogenase (gdh), aspartate semialdehyde dehydrogenase (asd), dihydropicolinate reductase (dapB), and meso-diaminopimelate dehydrogenase (ddh), wherein the variant enzyme exhibits dual specificity for coenzymes NADH and NADPH, wherein the method comprises expressing a variant enzyme of asd, wherein the variant enzyme comprises an amino acid sequence that is at least 95% identical to the amino acid sequence of SEQ ID NO:40.

In some embodiments the present disclosure teaches a method of improving efficiency of production of a compound produced using NADPH by a host cell, comprising: expressing, in the host cell, a variant enzyme of one or more of the enzymes glutamate dehydrogenase (gdh), aspartate semialdehyde dehydrogenase (asd), dihydropicolinate reductase (dapB), and meso-diaminopimelate dehydrogenase (ddh), wherein the variant enzyme exhibits dual specificity for coenzymes NADH and NADPH, wherein the method comprises expressing a variant enzyme of dapB, wherein the variant enzyme comprises an amino acid sequence that is at least 95% identical to the amino acid sequence of SEQ ID NO:46.

In some embodiments the present disclosure teaches a method of improving efficiency of production of a compound produced using NADPH by a host cell, comprising: expressing, in the host cell, a variant enzyme of one or more of the enzymes glutamate dehydrogenase (gdh), aspartate semialdehyde dehydrogenase (asd), dihydropicolinate reductase (dapB), and meso-diaminopimelate dehydrogenase (ddh), wherein the variant enzyme exhibits dual specificity for coenzymes NADH and NADPH, wherein the method comprises expressing a ddh, wherein the ddh enzyme comprises an amino acid sequence of SEQ ID NO:4.

In some embodiments the present disclosure teaches a method of improving efficiency of production of a compound produced using NADPH by a host cell, comprising: expressing, in the host cell, a variant enzyme of one or more of the enzymes glutamate dehydrogenase (gdh), aspartate semialdehyde dehydrogenase (asd), dihydropicolinate reductase (dapB), and meso-diaminopimelate dehydrogenase (ddh), wherein the variant enzyme exhibits dual specificity for coenzymes NADH and NADPH, wherein the variant enzyme of gdh comprises an amino acid sequence of SEQ ID NO:44.

In some embodiments the present disclosure teaches a method of improving efficiency of production of a compound produced using NADPH by a host cell, comprising: expressing, in the host cell, a variant enzyme of one or more of the enzymes glutamate dehydrogenase (gdh), aspartate semialdehyde dehydrogenase (asd), dihydropicolinate reductase (dapB), and meso-diaminopimelate dehydrogenase (ddh), wherein the variant enzyme exhibits dual specificity for coenzymes NADH and NADPH, wherein the variant enzyme of asd comprises an amino acid sequence of SEQ ID NO:30.

In some embodiments the present disclosure teaches a method of improving efficiency of production of a compound produced using NADPH by a host cell, comprising: expressing, in the host cell, a variant enzyme of one or more of the enzymes glutamate dehydrogenase (gdh), aspartate semialdehyde dehydrogenase (asd), dihydropicolinate reductase (dapB), and meso-diaminopimelate dehydrogenase (ddh), wherein the variant enzyme exhibits dual specificity for coenzymes NADH and NADPH, wherein the variant enzyme of dapB comprises an amino acid sequence of SEQ ID NO:48.

In some embodiments the present disclosure teaches a method of improving efficiency of production of a compound produced using NADPH by a host cell, comprising: expressing, in the host cell, a variant enzyme of one or more of the enzymes glutamate dehydrogenase (gdh), aspartate semialdehyde dehydrogenase (asd), dihydropicolinate reductase (dapB), and meso-diaminopimelate dehydrogenase (ddh), wherein the variant enzyme exhibits dual specificity for coenzymes NADH and NADPH, wherein variants of all four enzymes are expressed simultaneously in the host cell.

In some embodiments, the present disclosure teaches a host cell comprising: a variant of one or more enzymes gdh, asd, dapB, and ddh, wherein the variant exhibits dual specificity for coenzymes NADH and NADPH.

In some embodiments, the present disclosure teaches a method of improving efficiency of L-lysine production by a host cell, comprising expressing, in the host cell, a novel nicotinamide nucleotide transhydrogenase.

In some embodiments, the present disclosure teaches a method of improving efficiency of L-lysine production by a host cell, comprising two or more of the following: (1) modifying an endogenous GAPDH such that the modified GAPDH has an increased specificity to coenzyme NADP relative to the corresponding naturally occurring GAPDH; (2) expressing, in the host cell, a variant enzyme of one or more of the enzymes glutamate dehydrogenase (gdh), aspartate semialdehyde dehydrogenase (asd), dihydropicolinate reductase (dapB), and meso-diaminopimelate dehydrogenase (ddh), wherein the variant enzyme exhibits dual specificity for coenzymes NADH and NADPH; and (3) expressing, in the host cell, a novel nicotinamide nucleotide transhydrogenase.

In some embodiments, the present disclosure teaches a method of increasng L-lysine, L-threonine, L-isoleucine, L-methionine, or L-glycine production by two or more of: (1) engineering the glycolytic pathway to produce NADPH by broadening the coenzyme specificity of the endogenous glycolytic enzyme Glyceraldehyde-3-phosphate dehydrogenase (gapA) such that the enzyme possesses dual specificity for NADP and NAD; (2) expressing a transhydrogenase enzyme in the host cell that generates NADPH from NADH; (3) reprogramming the DAP-pathway for lysine synthesis by expressing homologues of the endogenous gdh, asd, dapB and ddh enzymes, that use NADH more effectively than NADPH as a cofactor; (4) reprogramming the thrABC-pathway for threonine synthesis by expressing homologues of the endogenous gdh and asd enzymes, that use NADH more effectively than NADPH as a cofactor; (5) reprogramming threonine synthesis by expressing homologues of the endogenous L-threonine aldolase (1TA) that decrease or reverse degradation of threonine to glycine; and (6) expressing a heterologous pyruvate carboxylase (pyc) or homologues thereof to increase synthesis of oxaloacetate, or increasing expression of an endogenous pyc.

BRIEF DESCRIPTION OF THE FIGURES

FIG. 5A shows data for two *C. glutamicum* recombinant strains, 7000186960 and 7000186992, each containing the native enzyme for ddh and the same 3 heterologous enzymes for gdh, asd, and dapB (the known versions of gdh and dapB that use the NADH, and a variant of asd from *Lactobacillus agilis*) that showed a significantly improved productivity of L-lysine compared to their respective parents Parent_3 and Parent_4. 7000186960 and 7000186992 each contain the same 3 heterologous enzymes for gdh, asd, and dapB and the native enzyme for ddh. FIG. 5B shows that heterologous enzymes for gdh and dapB also increase yield slightly in 2 of 3 backgrounds tested

The insert DNA is generated by combining one or more synthesized oligos in an assembly reaction. DNA inserts containing the desired sequence are flanked by regions of DNA homologous to the targeted region of the genome. These homologous regions facilitate genomic integration, and, once integrated, form direct repeat regions designed for looping out vector backbone DNA in subsequent steps. Assembled plasmids contain the insert DNA, and optionally, one or more selection markers.

Figure 7:
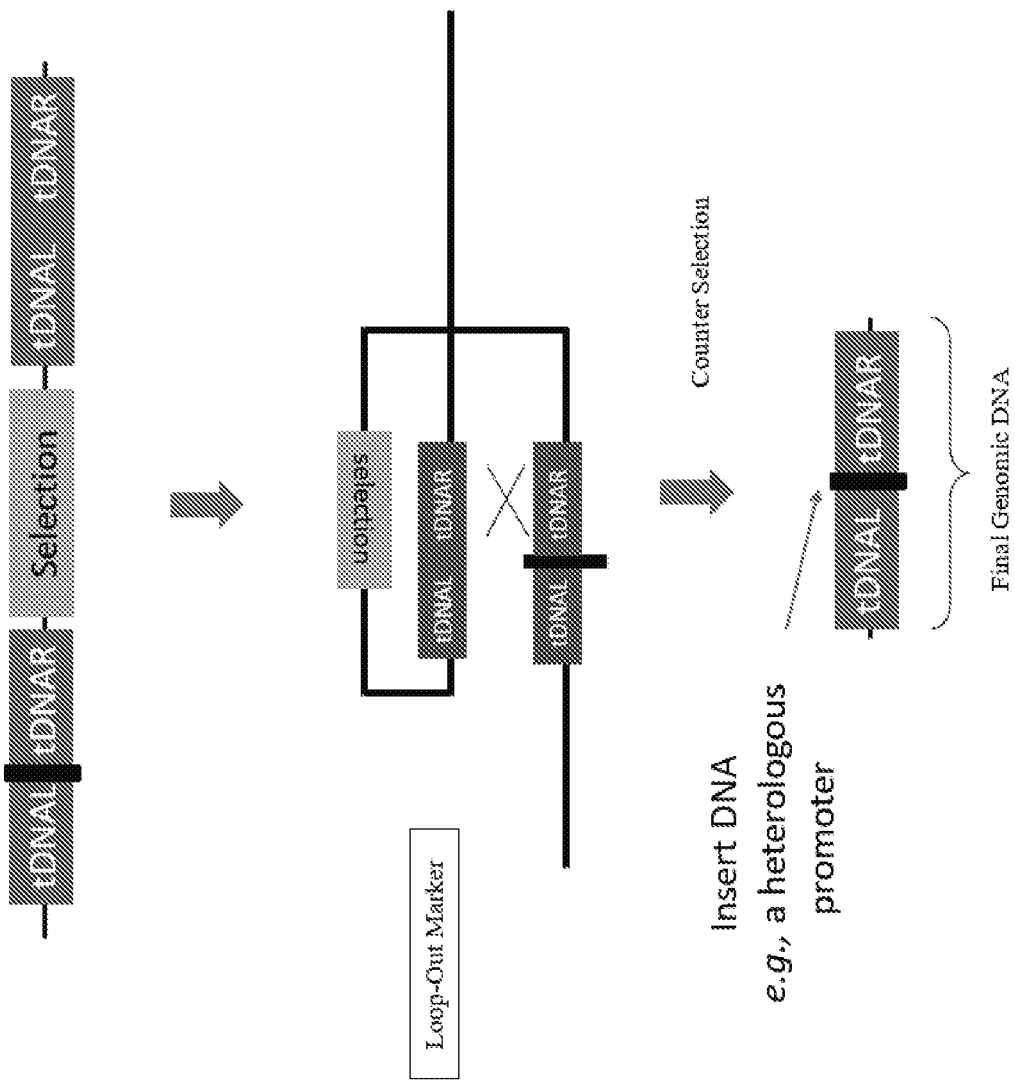

FIG. 7 depicts procedure for looping-out selected regions of DNA from host strains. Direct repeat regions of the inserted DNA and host microbial genome can "loop out" in a recombination event. Cells counter selected for the selection marker contain deletions of the loop DNA flanked by the direct repeat regions.

Figure 8A:
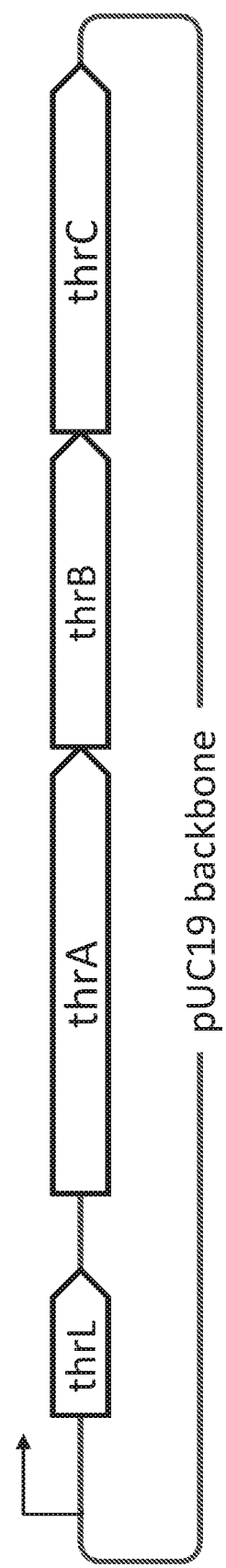
Figure 8B:
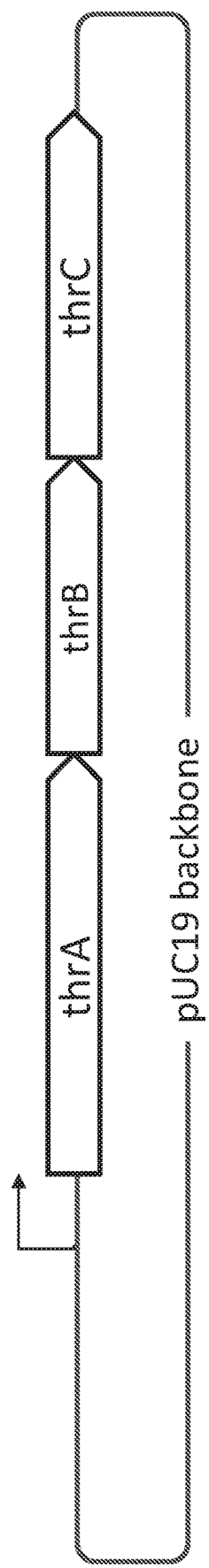

FIG. 8A-B show plasmid designs used for step one of E. coli W3110 threonine base strain construction using thrLABC regulon (FIG. 8A) or the thrABC operon (FIG. 8B) in E. coli K-12, W3110.

Figure 9:
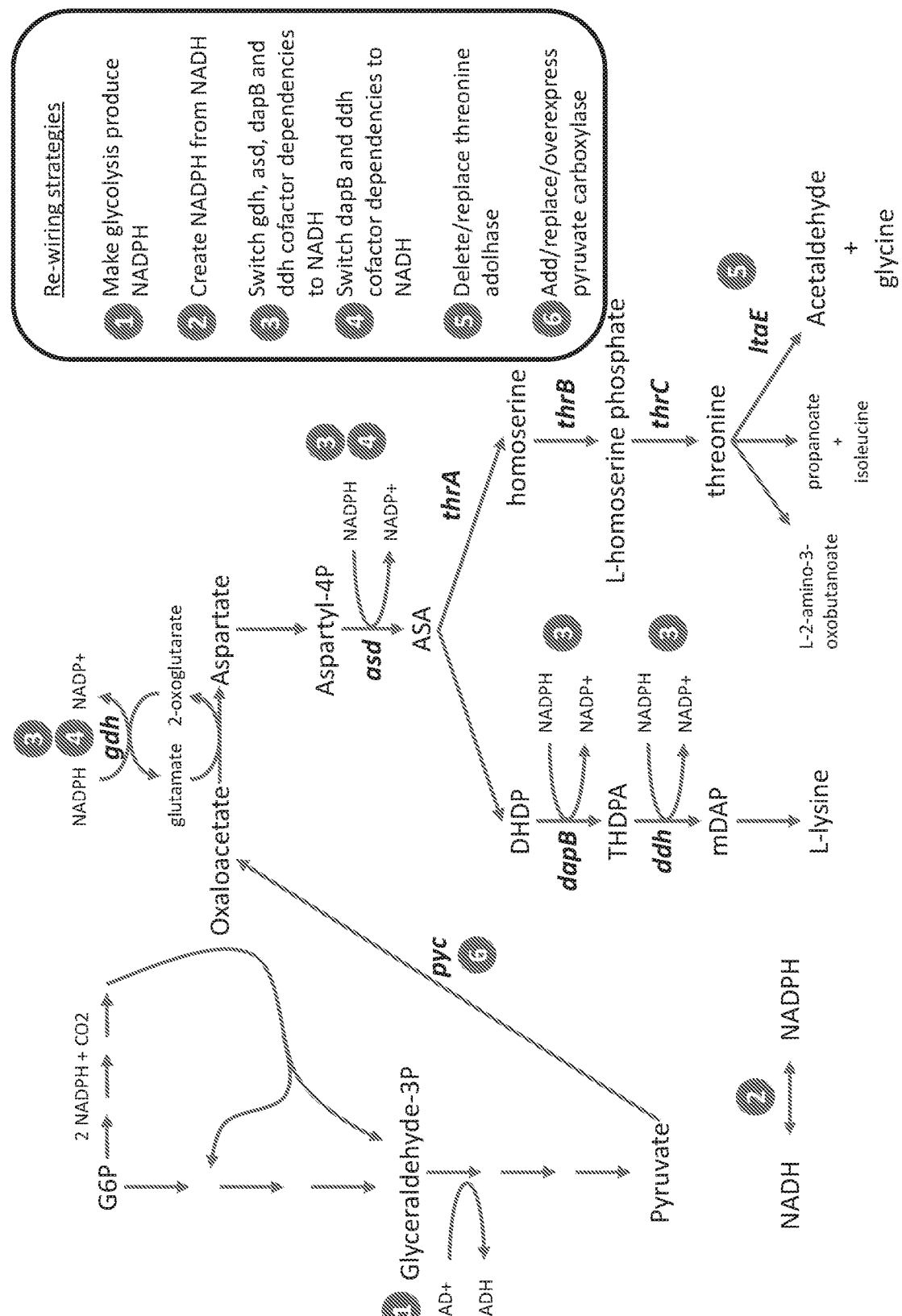

FIG. 9 illustrates the bacterial biosynthetic pathway for lysine and threonine, and outlines the strategies employed in the present application to improve yield and productivity of L-lysine or L-threonine in bacteria. (1) Engineering the glycolytic pathway to produce NADPH by broadening the coenzyme specificity of the endogenous glycolytic enzyme Glyceraldehyde-3-phosphate dehydrogenase (gapA) such that the enzyme possesses dual specificity for NADP and NAD results in production of NADPH. (2) Expressing a transhydrogenase enzyme in the host cell that generate NADPH from NADH results in production of NADPH. (3) Reprogramming the DAP-pathway for lysine synthesis by expressing homologues of the endogenous gdh, asd, dapB and ddh enzymes, that use NADH more effectively than NADPH as a cofactor results in decreased NADPH utilization. (4) Reprogramming the thrABC-pathway for threonine synthesis by expressing homologues of the endogenous gdh and asd enzymes, that use NADH more effectively than NADPH as a cofactor, resulting in decreased NADPH utilization. (5) Reprogramming threonine synthesis by expressing homologues of the endogenous L-threonine aldohase (ltA) that decrease or reverse degradation of threonine to glycine, resulting in increase threonine production per unit of NADPH expended (6) Expressing a heterologous pyruvate carboxylase (pyc) or homologues thereof to increase synthesis of oxaloacetate or increasing expression of an endogenous pyc.

Figure 10A:
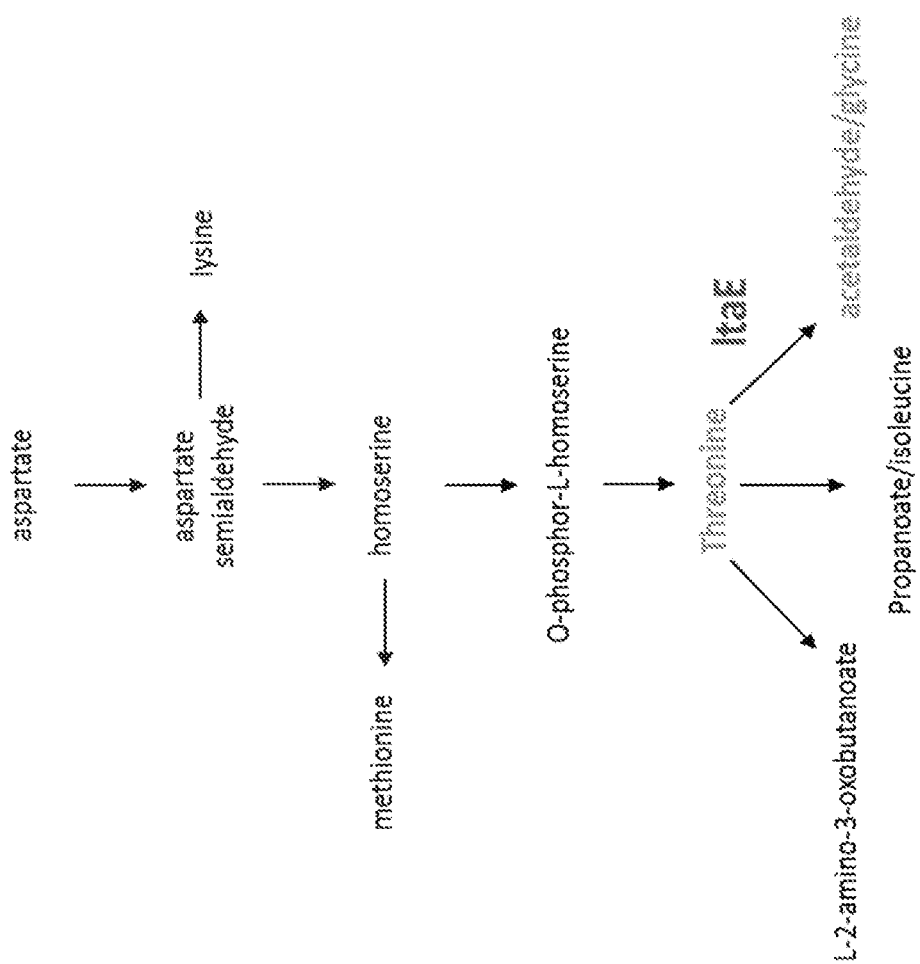
Figure 10B:
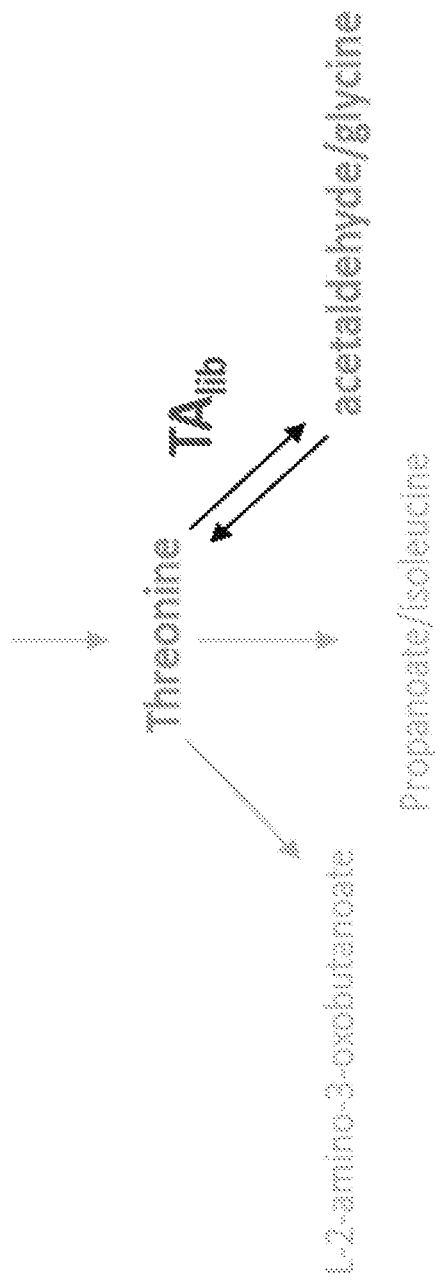
Figure 10C:
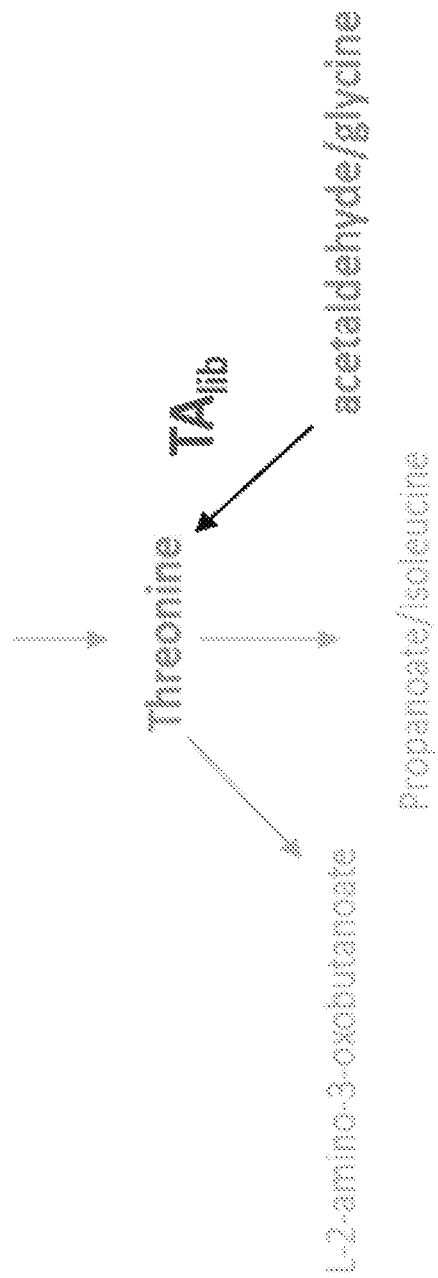

FIG. 10A-C depict a metabolic pathway map of threonine biosynthesis showing possible scenarios realized by expression of the heterologous threonine aldolase library (TA$_{lib}$). FIG. 10A depicts a metabolic pathway map of threonine biosynthesis showing the reaction (conversion of threonine to acetaldehyde and glycine) favored by the native E. coli ltaE. FIG. 10B depicts a partial pathway showing an improved scenario, in which the conversion between threonine and acetaldehyde and glycine is more balanced with expression of the heterologous TA enzyme. FIG. 10C depicts a partial pathway showing the preferred scenario, in which the conversion of acetaldehyde and glycine to threonine is the favored direction with expression of the heterologous TA enzyme.

Figure 11A:
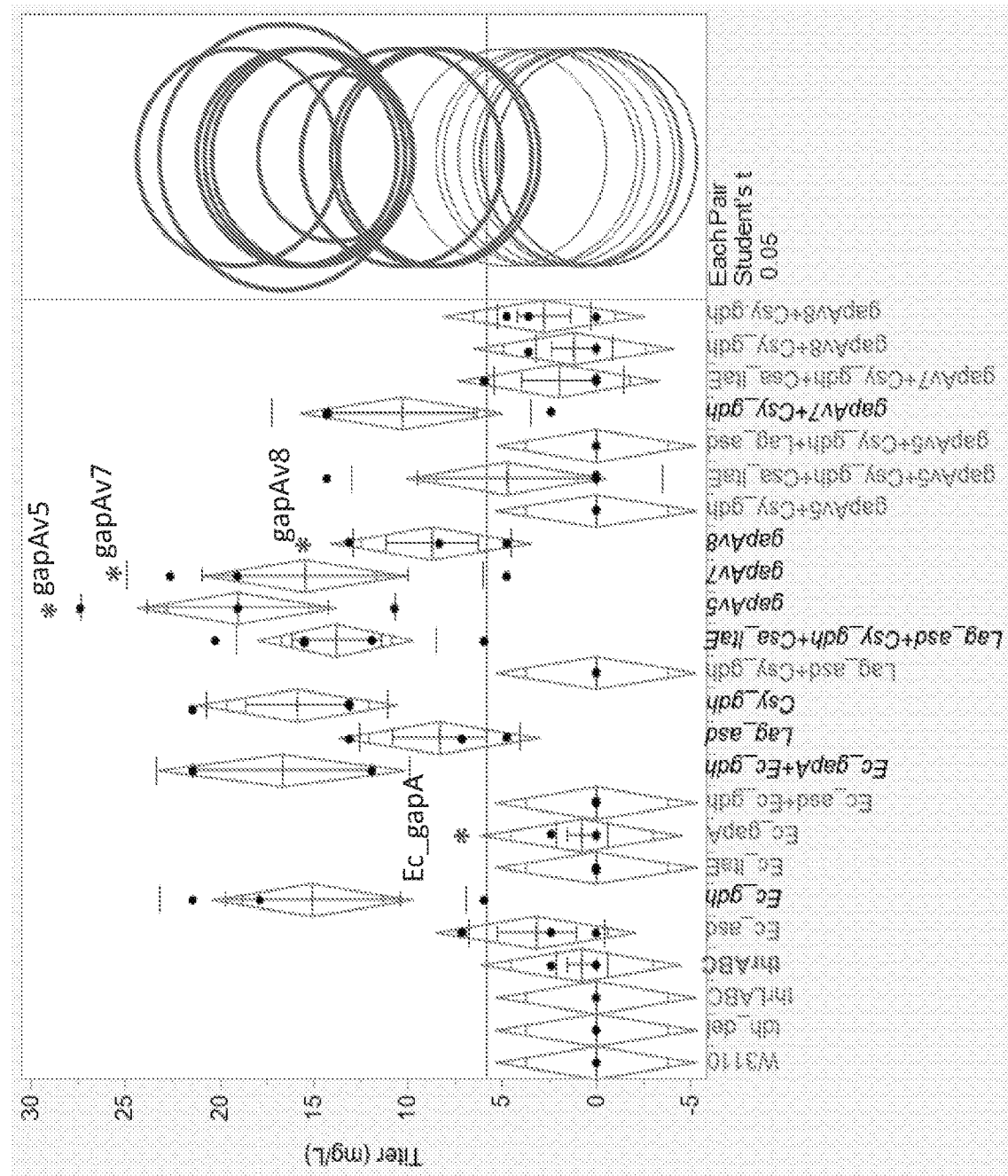
Figure 11B:
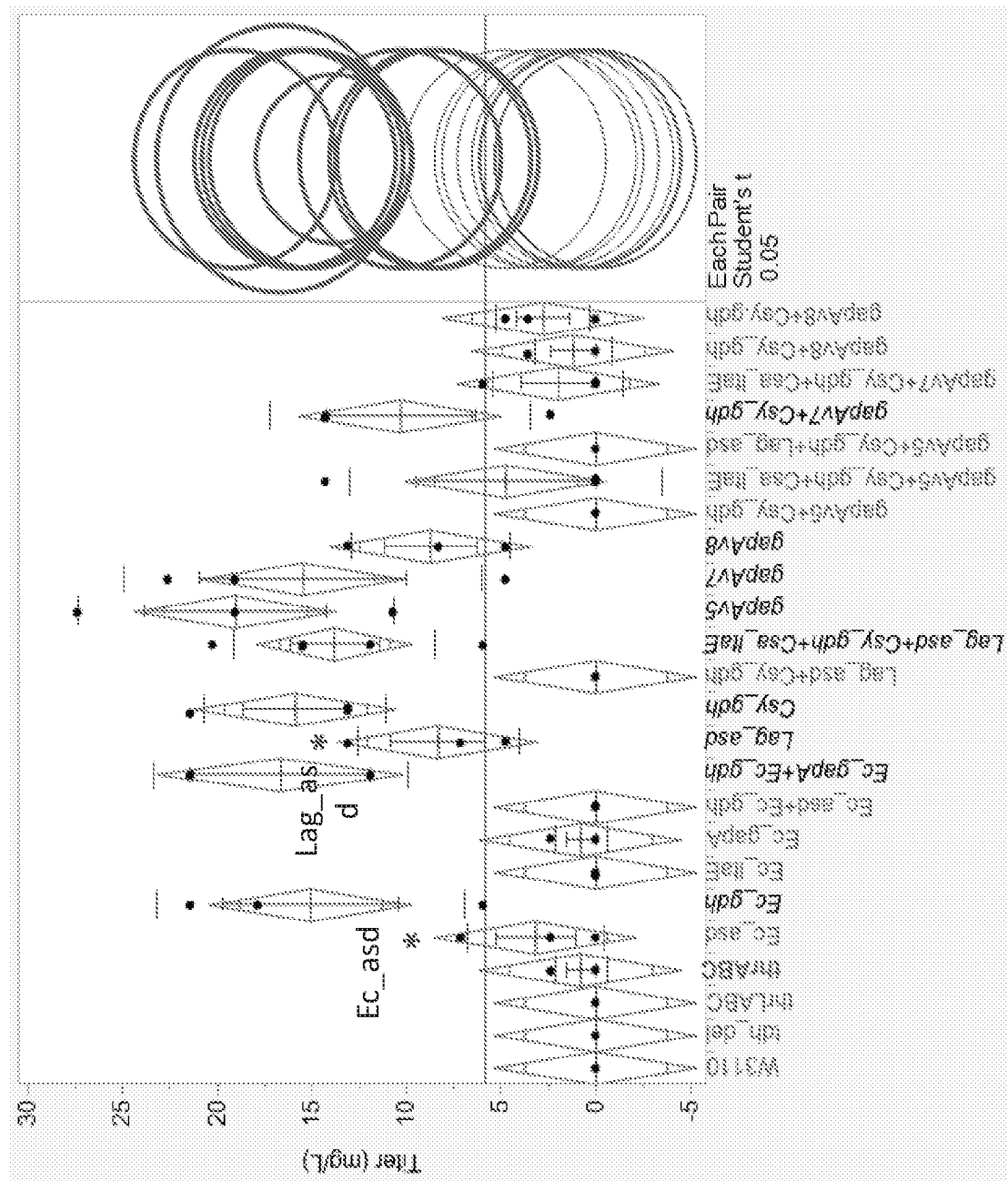
Figure 11C:
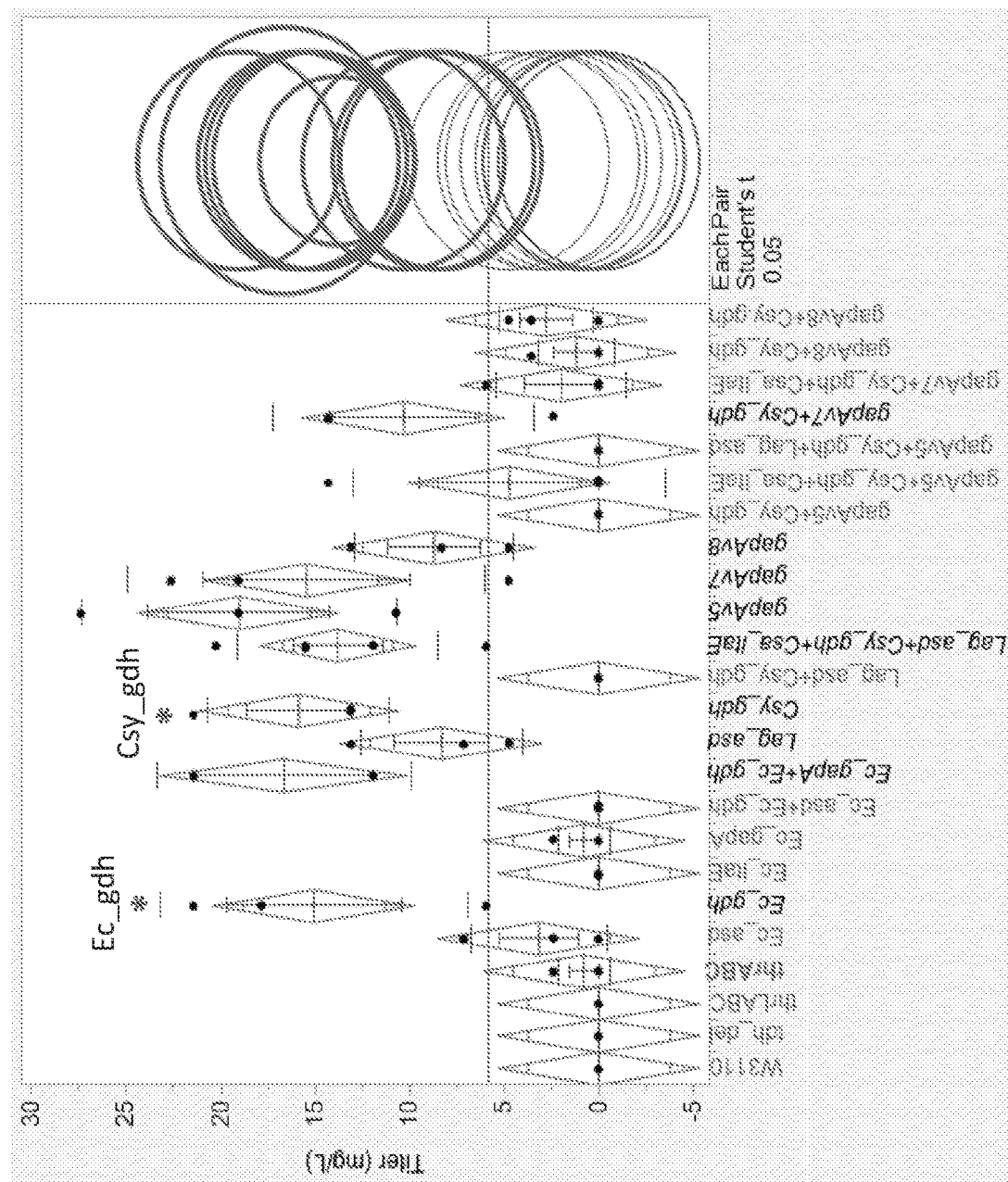

FIG. 11A-C show titer (mg/L) of L-threonine produced by the E. coli thrABC background strain (W3110 pMB085thrABCΔtdh; thrABC) when expressing individual genes or combinations of native or variants of gapA, gsd, asd, ltaE that were also tested in Coryne. Titers of the wild-type E. coli K12 W3110, W3110 with deletion of tdh (tdh_del), and W3110 pMB085thrLABCΔtdh (thrLABC) strains are also shown for comparison. FIG. 11A shows results for gapA. The three gapA variants we tested (gapAv5, gapAv7 and gapAv8) all resulted in significantly higher L-threonine titer relative to controls, including a strain expressing an extra copy of the E. coli gapA (Ec_gapA). FIG. 11B shows results for asd. Lactobacillus agilis asd resulted in significantly higher titer than the same base strain expressing a second copy of E. coli asd. FIG. 11C shows results for gdh. In this case, Clostridium gdh (Csy_gdh) was not significantly different than the same base strain expressing a second copy of E. coli gdh, but bother strains performed better than the parent strain (thrABC).

Figure 12:
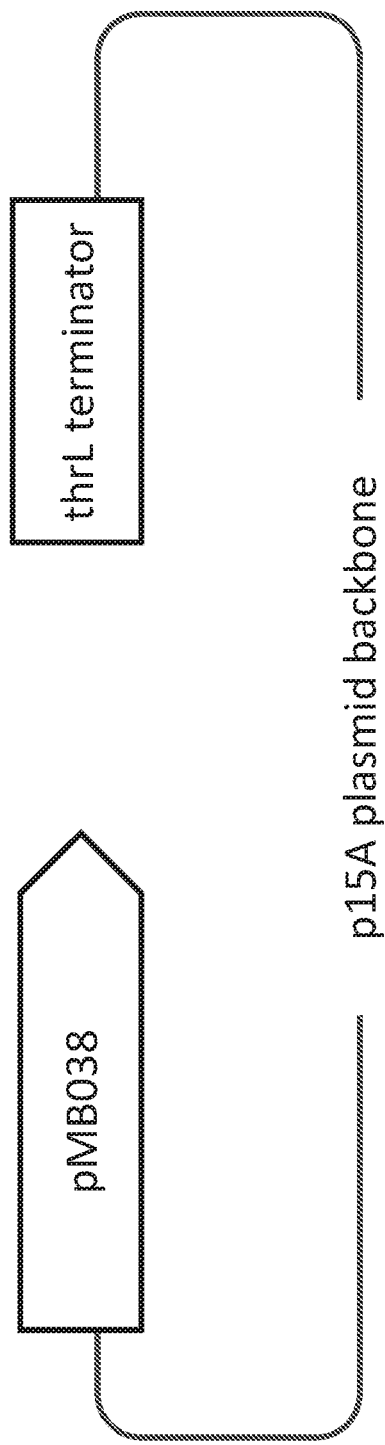

FIG. 12 shows the design of regulatory elements (pMB038 promoter (SEQ ID NO: 237) and thrL terminator (SEQ ID NO: 238) and backbone (p15A) (SEQ ID NO: 239) used to construct plasmids used for expression of asd, gdh and ltaE library variants.

Figure 13:
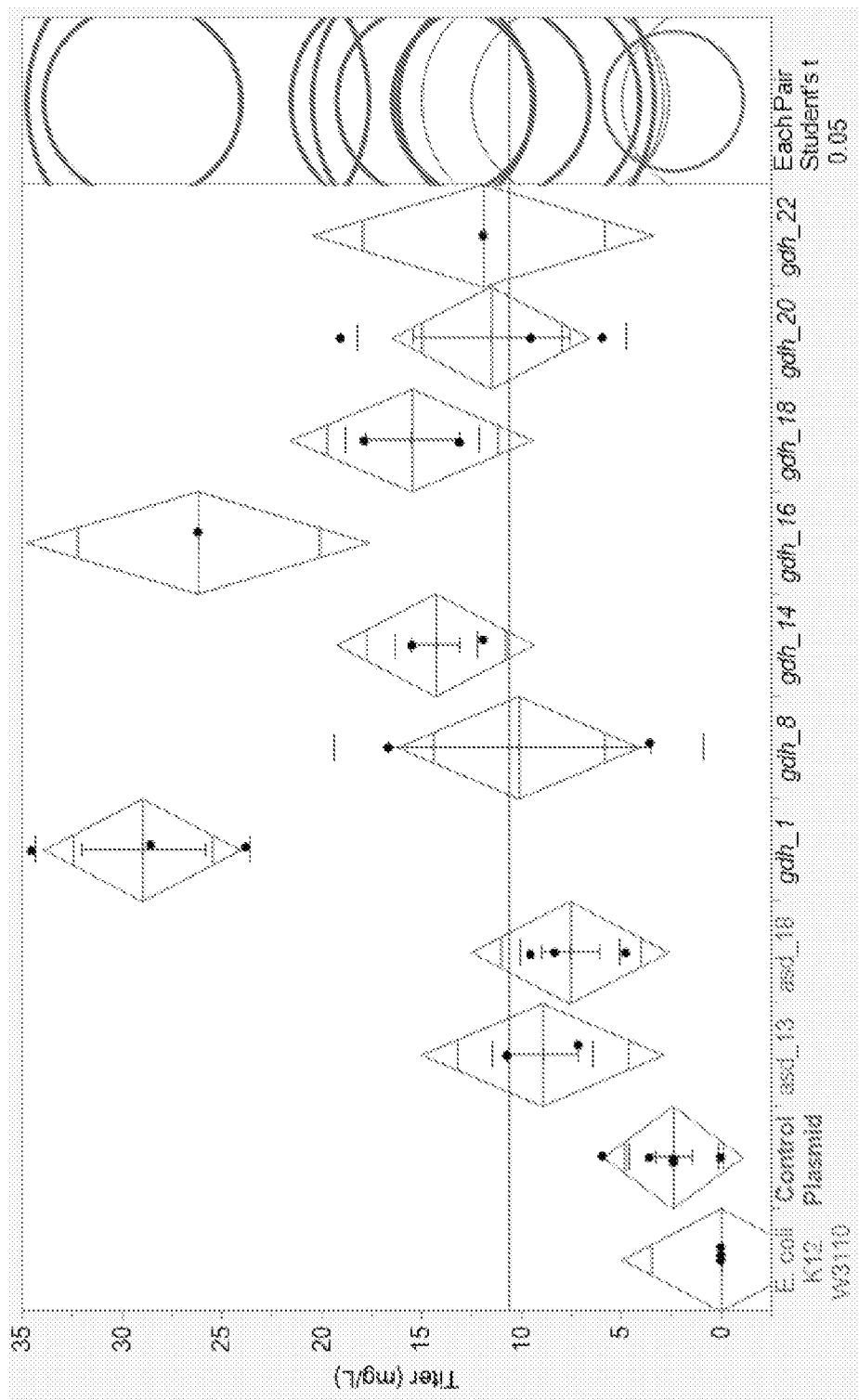

FIG. 13 shows improved titer (mg/L) of L-threonine compared to the wild-type E. coli K12 W3110 and a parent, control strain—threonine base strain THR02 (W3110 pMB085thrABCΔtdh) transformed with a p15A empty vector (a circularized p15A plasmid (SEQ ID NO: 239) without a library variant cloned between the pMB038 promoter (SEQ ID NO: 237) and terminator (SEQ ID NO: 238); Control Plasmid). Strains expressing asd 13 (SEQ ID NO:108) and asd 18 (SEQ ID NO:118) had improved tier but were not significantly different from the control strain. Seven gdh variants: gdh_1 (SEQ ID NO:136) gdh_8 (SEQ ID NO:150), gdh_14 (SEQ ID NO:162), gdh_16 (SEQ ID NO:166), gdh_18 (SEQ ID NO:170), gdh_20 (SEQ ID NO:174) and gdh_22 (SEQ ID NO:178) all resulted in significantly higher L-threonine titer, determined by Student's T comparison of means. Grey circles and labels indicate samples that performed significantly better than the control strain.

Figure 14:
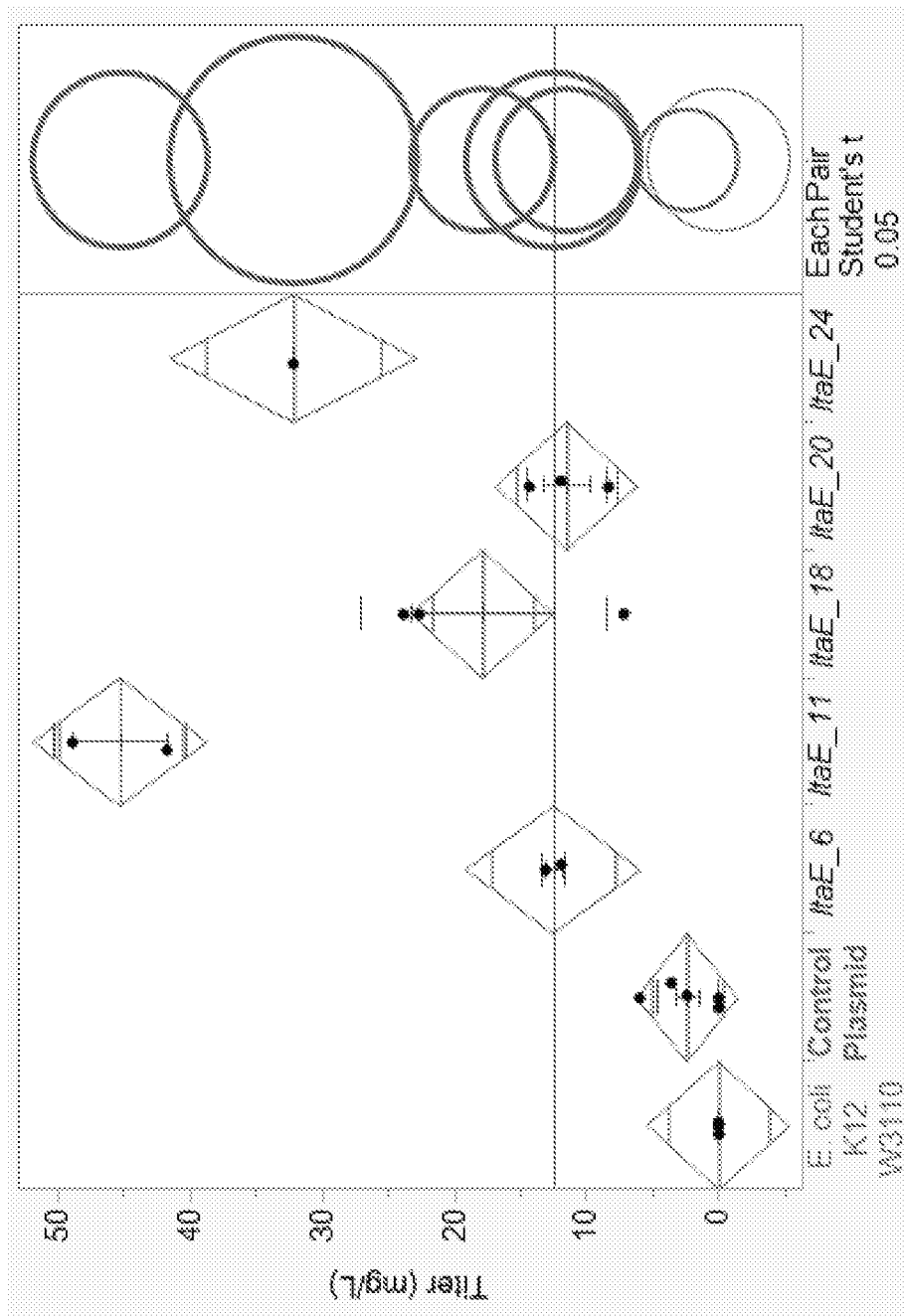

FIG. 14 shows improved L-threonine titer (mg/L) resulting from strains expressing threonine aldolase (ltaE) library variants compared to the wild-type E. coli K12 W3110 and a parent, control strain—threonine base strain THR02 (W3110 pMB085thrABCΔtdh) transformed with a p15A empty vector (a circularized p15A plasmid (SEQ ID NO: 239) without a library variant cloned between the pMB038 promoter (SEQ ID NO: 237) and terminator (SEQ ID NO: 238); Control Plasmid). ltaE_6 (SEQ ID NO:196), ltaE 11 (SEQ ID NO:206), ltaE_18 (SEQ ID NO:220), ltaE_20 (SEQ ID NO:224), lta_24 (SEQ ID NO: 232) all resulted in significantly higher L-threonine titer, determined by Student's T comparison of means. Grey circles and labels indicate samples that performed significantly better than the control strain.

Figure 15:
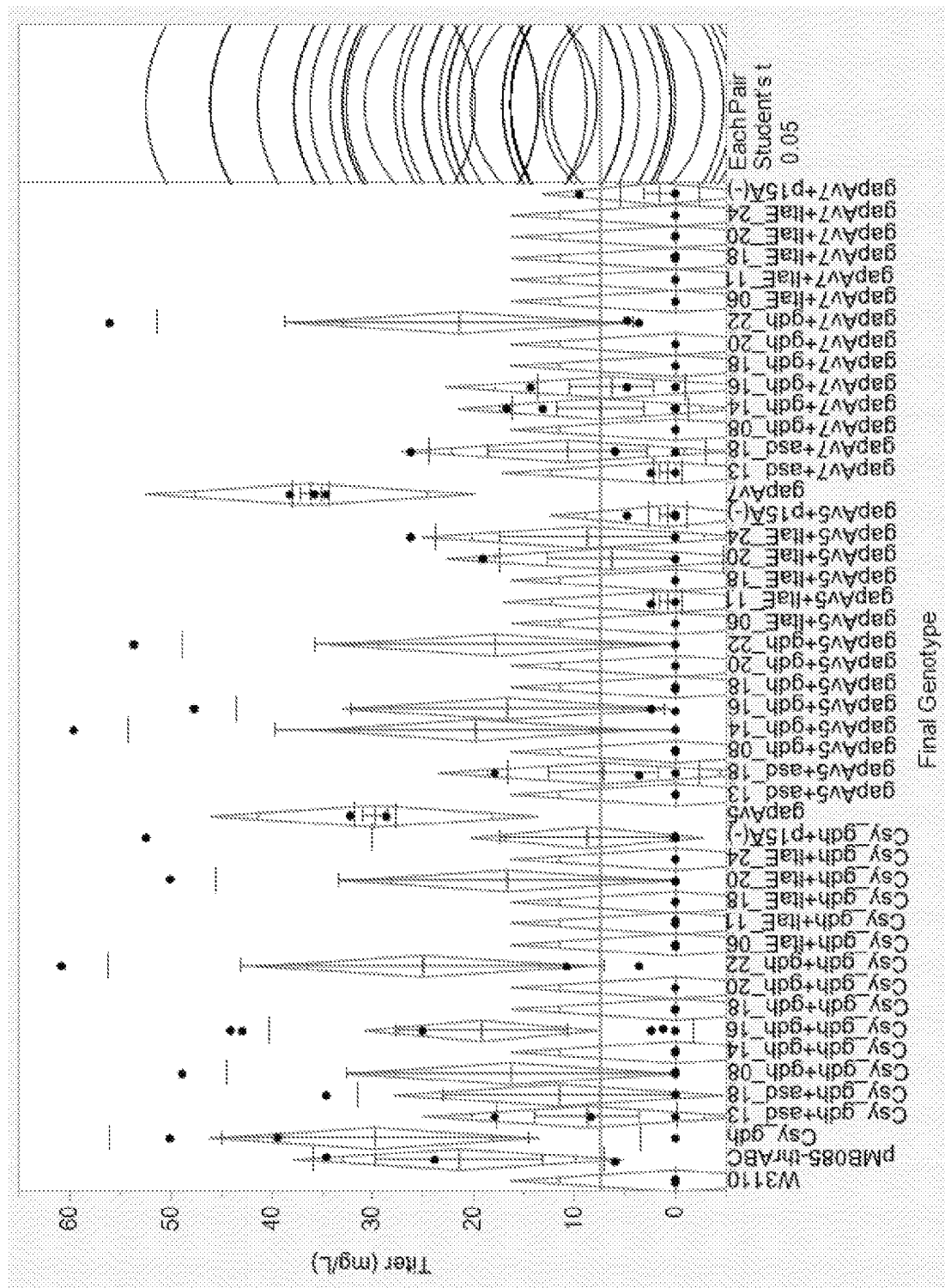

FIG. 15 shows improved threonine titer resulting from strains expressing combinations of Csy_gdh, gapAv5 or gapAv7 with single asd, gdh, or ltaE library variants that each improved titer when expressed individually. All strains shown, except W3110, are in a pMB085-thrABC tdh deletion background. For these experiments, the most relevant controls are the parents strain (Csy_gdh, gapAv5 and gapAv7) transformed with the empty p15A control plasmid (7000349886, 7000349887 and 7000349885; Csy_gdh+ p15A(–), gapAv5+p15A(–) and gapAv7+p15A(–), respectively).

Figure 16:
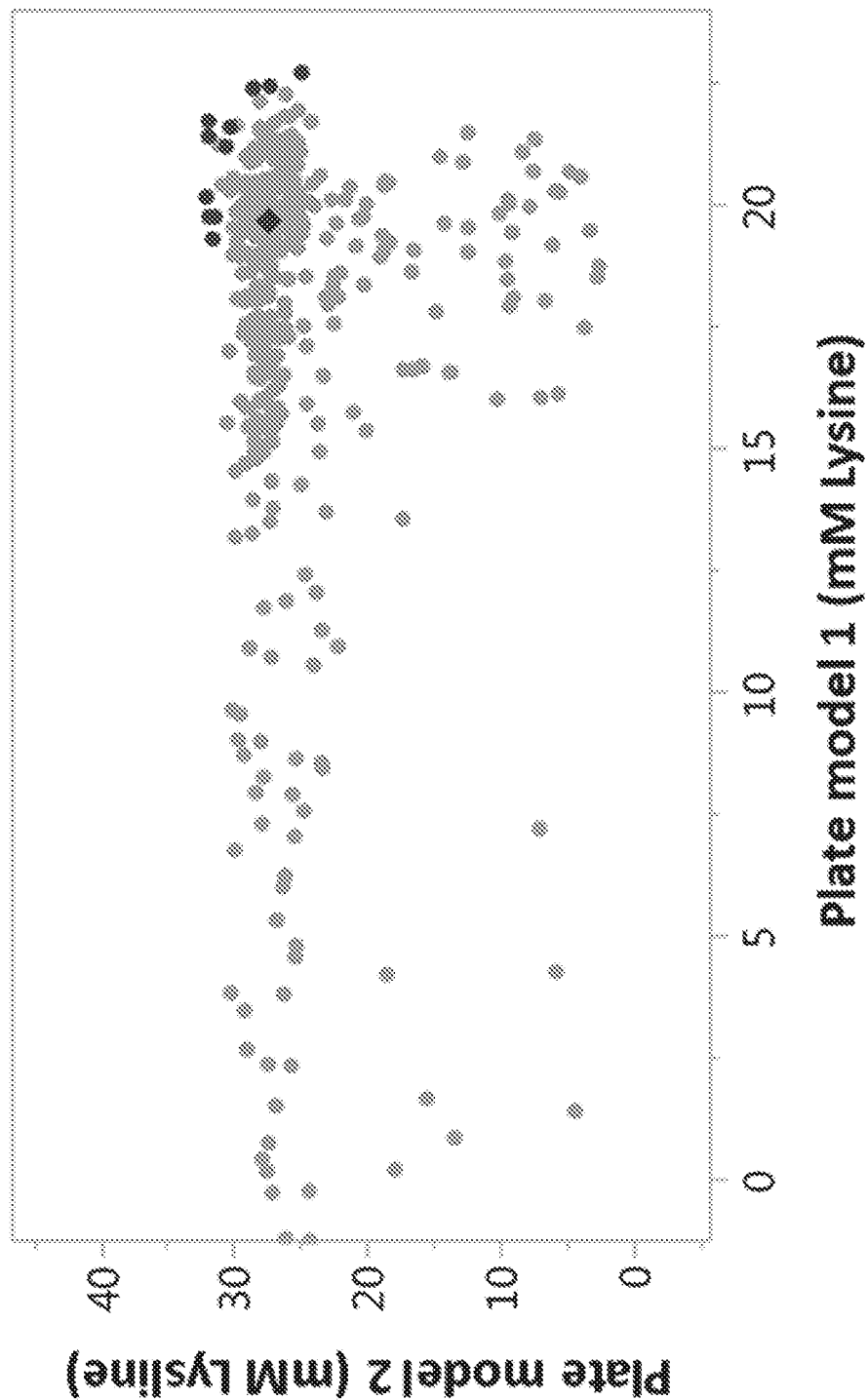

FIG. 16 depicts library performance in two plate models for production of lysine by C. glutamicum expressing an exogenous gapA allele from an NNK library. Average performance in each model is plotted. Most integrants (gray circles) perform equal to or worse than parent (black diamond). Certain gapA alleles result in high titers of lysine in both plate models (black circles).

DETAILED DESCRIPTION

Definitions

While the following terms are believed to be well understood by one of ordinary skill in the art, the following definitions are set forth to facilitate explanation of the presently disclosed subject matter.

The term "a" or "an" refers to one or more of that entity, i.e. can refer to a plural referents. As such, the terms "a" or "an", "one or more" and "at least one" are used interchangeably herein. In addition, reference to "an element" by the indefinite article "a" or "an" does not exclude the possibility that more than one of the elements is present, unless the context clearly requires that there is one and only one of the elements.

Unless the context requires otherwise, throughout the present specification and claims, the word "comprise" and variations thereof, such as, "comprises" and "comprising" are to be construed in an open, inclusive sense that is as "including, but not limited to".

Reference throughout this specification to "one embodiment" or "an embodiment" means that a particular feature, structure or characteristic described in connection with the embodiment may be included in at least one embodiment of the present disclosure. Thus, the appearances of the phrases "in one embodiment" or "in an embodiment" in various places throughout this specification may not necessarily all refer to the same embodiment. It is appreciated that certain features of the disclosure, which are, for clarity, described in the context of separate embodiments, may also be provided in combination in a single embodiment. Conversely, various features of the disclosure, which are, for brevity, described in the context of a single embodiment, may also be provided separately or in any suitable sub-combination.

As used herein the terms "cellular organism" "microorganism" or "microbe" should be taken broadly. These terms can be used interchangeably and include, but may not be limited to, the two prokaryotic domains, Bacteria and Archaea, as well as certain eukaryotic fungi and protists. In some embodiments, the disclosure refers to the "microorganisms" or "cellular organisms" or "microbes" of lists/ tables and figures present in the disclosure. This characterization can refer to not only the identified taxonomic genera of the tables and figures, but also the identified taxonomic species, as well as the various novel and newly identified or designed strains of any organism in said tables or figures. The same characterization holds true for the recitation of these terms in other parts of the Specification, such as in the Examples.

The term "prokaryotes" is art recognized and refers to cells which contain no nucleus or other cell organelles. The prokaryotes are generally classified in one of two domains, the Bacteria and the Archaea. The definitive difference between organisms of the Archaea and Bacteria domains is based on fundamental differences in the nucleotide base sequence in the 16S ribosomal RNA.

The term "Archaea" refers to a categorization of organisms of the division Mendosicutes, typically found in unusual environments and distinguished from the rest of the prokaryotes by several criteria, including the number of ribosomal proteins and the lack of muramic acid in cell walls. On the basis of ssrRNA analysis, the Archaea consist of two phylogenetically-distinct groups: Crenarchaeota and Euryarchaeota. On the basis of their physiology, the Archaea can be organized into three types: methanogens (prokaryotes that produce methane); extreme halophiles (prokaryotes that live at very high concentrations of salt (NaCl); and extreme (hyper) *thermophilus* (prokaryotes that live at very high temperatures). Besides the unifying archaeal features that distinguish them from Bacteria (i.e., no murein in cell wall, ester-linked membrane lipids, etc.), these prokaryotes exhibit unique structural or biochemical attributes which adapt them to their particular habitats. The Crenarchaeota consists mainly of hyperthermophilic sulfur-dependent prokaryotes and the Euryarchaeota contains the methanogens and extreme halophiles.

"Bacteria" or "eubacteria" refers to a domain of prokaryotic organisms. Bacteria include at least 11 distinct groups as follows: (1) Gram-positive (gram+) bacteria, of which there are two major subdivisions: (1) high G+C group (*Actinomycetes, Mycobacteria, Micrococcus*, others) (2) low G+C group (*Bacillus, Clostridia, Lactobacillus, Staphylococci, Streptococci, Mycoplasmas*); (2) Proteobacteria, e.g., Purple photosynthetic+non-photosynthetic Gram-negative bacteria (includes most "common" Gram-negative bacteria); (3) Cyanobacteria, e.g., oxygenic phototrophs; (4) Spirochetes and related species; (5) Planctomyces; (6) *Bacteroides, Flavobacteria*; (7) *Chlamydia*; (8) Green sulfur bacteria; (9) Green non-sulfur bacteria (also anaerobic phototrophs); (10) Radioresistant micrococci and relatives; (11) *Thermotoga* and *Thermosipho thermophiles*.

A "eukaryote" is any organism whose cells contain a nucleus and other organelles enclosed within membranes. Eukaryotes belong to the taxon Eukarya or Eukaryota. The defining feature that sets eukaryotic cells apart from prokaryotic cells (the aforementioned Bacteria and Archaea) is that they have membrane-bound organelles, especially the nucleus, which contains the genetic material, and is enclosed by the nuclear envelope.

The terms "genetically modified host cell," "genetically modified microorganism," "recombinant microorganism," "recombinant host cell," and "recombinant strain" can be used interchangeably herein and can refer to microorganisms that have been genetically modified. Thus, the terms include a microorganism (e.g., bacteria, yeast cell, fungal cell, etc.) that has been genetically altered, modified, or engineered, such that it exhibits an altered, modified, or different genotype and/or phenotype (e.g., when the genetic modification affects coding nucleic acid sequences of the microorganism), as compared to the naturally-occurring microorganism from which it was derived. It is understood that the terms refer not only to the particular recombinant microorganism in question, but also to the progeny or potential progeny of such a microorganism.

The term "wild-type microorganism" can describe a cell that occurs in nature, i.e. a cell that has not been genetically modified.

The term "genetically engineered" may refer to any manipulation of a microorganism's genome (e.g. by insertion or deletion of nucleic acids).

The term "control" or "control host cell" refers to an appropriate comparator host cell for determining the effect of a genetic modification or experimental treatment. In some embodiments, the control host cell is a wild type cell. In other embodiments, a control host cell is genetically identical to the genetically modified host cell, save for the genetic modification(s) differentiating the treatment host cell. In some embodiments, the present disclosure teaches the use of parent strains as control host cells (e.g., the $S_1$ strain that was used as the basis for the strain improvement program).

As used herein, the term "allele(s)" can mean any of one or more alternative forms of a gene, all of which alleles relate to at least one trait or characteristic. In a diploid cell, the two alleles of a given gene can occupy corresponding loci on a pair of homologous chromosomes. Since the present disclosure, in embodiments, relates to QTLs, i.e. genomic regions that may comprise one or more genes or regulatory sequences, it is in some instances more accurate to refer to "haplotype" (i.e. an allele of a chromosomal segment) instead of "allele", however, in those instances, the term "allele" should be understood to comprise the term "haplotype".

As used herein, the term "locus" (loci plural) can mean a specific place or places or a site on a chromosome where for example a gene or genetic marker is found.

As used herein, the term "genetically linked" can refer to two or more traits that are co-inherited at a high rate during breeding such that they are difficult to separate through crossing.

A "recombination" or "recombination event" as used herein can refer to a chromosomal crossing over or independent assortment. The term "recombinant" can refer to an organism having a new genetic makeup arising as a result of a recombination event.

As used herein, the term "phenotype" can refer to the observable characteristics of an individual cell, cell culture, organism, or group of organisms which results from the interaction between that individual's genetic makeup (i.e., genotype) and the environment.

As used herein, the term "chimeric" or "recombinant" when describing a nucleic acid sequence or a protein sequence can refer to a nucleic acid, or a protein sequence, that links at least two heterologous polynucleotides, or two heterologous polypeptides, into a single macromolecule, or that can re-arrange one or more elements of at least one natural nucleic acid or protein sequence. For example, the term "recombinant" can refer to an artificial combination of two otherwise separated segments of sequence, e.g., by chemical synthesis or by the manipulation of isolated segments of nucleic acids by genetic engineering techniques.

As used herein, a "synthetic nucleotide sequence" or "synthetic polynucleotide sequence" can be a nucleotide sequence that is not known to occur in nature or that is not naturally occurring. Generally, such a synthetic nucleotide sequence will comprise at least one nucleotide difference when compared to any other naturally occurring nucleotide sequence.

As used herein, the term "nucleic acid" can refer to a polymeric form of nucleotides of any length, either ribonucleotides or deoxyribonucleotides, or analogs thereof. This term can refer to the primary structure of the molecule, and thus includes double- and single-stranded DNA, as well as double- and single-stranded RNA. It can also include modified nucleic acids such as methylated and/or capped nucleic acids, nucleic acids containing modified bases, backbone modifications, and the like. The terms "nucleic acid" and "nucleotide sequence" can be used interchangeably.

As used herein, the term "gene" can refer to any segment of DNA associated with a biological function. Thus, genes can include, but are not limited to, coding sequences and/or the regulatory sequences required for their expression. Genes can also include non-expressed DNA segments that, for example, form recognition sequences for other proteins. Genes can be obtained from a variety of sources, including cloning from a source of interest or synthesizing from known or predicted sequence information, and may include sequences designed to have desired parameters.

As used herein, the term "homologous" or "homologue" or "ortholog" is known in the art and can refer to related sequences that share a common ancestor or family member and are determined based on the degree of sequence identity. The terms "homology," "homologous," "substantially similar" and "corresponding substantially" can be used interchangeably herein. They can refer to nucleic acid fragments wherein changes in one or more nucleotide bases do not affect the ability of the nucleic acid fragment to mediate gene expression or produce a certain phenotype. These terms can also refer to modifications of the nucleic acid fragments of the instant disclosure such as deletion or insertion of one or more nucleotides that do not substantially alter the functional properties of the resulting nucleic acid fragment relative to the initial, unmodified fragment. It is therefore understood, as those skilled in the art will appreciate, that the disclosure can encompass more than the specific exemplary sequences. These terms can describe the relationship between a gene found in one species, subspecies, variety, cultivar or strain and the corresponding or equivalent gene in another species, subspecies, variety, cultivar or strain. For purposes of this disclosure homologous sequences can be compared. "Homologous sequences" or "homologues" or "orthologs" can be thought, believed, or known to be functionally related. A functional relationship may be indicated in any one of a number of ways, including, but not limited to: (a) degree of sequence identity and/or (b) the same or similar biological function. Preferably, both (a) and (b) are indicated. Homology can be determined using software programs readily available in the art, such as those discussed in Current Protocols in Molecular Biology (F. M. Ausubel et al., eds., 1987) Supplement 30, section 7.718, Table 6.71. Some alignment programs are MacVector (Oxford Molecular Ltd, Oxford, U.K.), ALIGN Plus (Scientific and Educational Software, Pennsylvania) and AlignX (Vector NTI, Invitrogen, Carlsbad, Calif.). Another alignment program is Sequencher (Gene Codes, Ann Arbor, Mich.), using default parameters.

As used herein, the term "variant enzyme" or "variant" refers to an enzyme that has a different amino acid sequence compared to the native enzyme in the organism in which the variant is expressed, but possesses the ability to catalyze a reaction the same as or similar to that catalyzed by the native enzyme.

As used herein, the term "endogenous" or "endogenous gene," refers to the naturally occurring gene, in the location in which it is naturally found within the host cell genome. In the context of the present disclosure, operably linking a heterologous promoter to an endogenous gene means genetically inserting a heterologous promoter sequence in front of an existing gene, in the location where that gene is naturally present. An endogenous gene as described herein can include alleles of naturally occurring genes that have been mutated according to any of the methods of the present disclosure.

As used herein, the term "exogenous" is used interchangeably with the term "heterologous," and refers to a substance coming from some source other than its native source. For example, the terms "exogenous protein," or "exogenous gene" refer to a protein or gene from a non-native source or location, and that have been artificially supplied to a biological system.

As used herein, the term "nucleotide change" can refer to, e.g., nucleotide substitution, deletion, and/or insertion, as is well understood in the art. For example, mutations contain alterations that produce silent substitutions, additions, or deletions, but do not alter the properties or activities of the encoded protein or how the proteins are made.

As used herein, the term "protein modification" can refer to, e.g., amino acid substitution, amino acid modification, deletion, and/or insertion, as is well understood in the art.

As used herein, the term "at least a portion" or "fragment" of a nucleic acid or polypeptide can mean a portion having the minimal size characteristics of such sequences, or any larger fragment of the full length molecule, up to and including the full length molecule. A fragment of a polynucleotide of the disclosure may encode a biologically active portion of a genetic regulatory element. A biologically active portion of a genetic regulatory element can be prepared by isolating a portion of one of the polynucleotides of the disclosure that comprises the genetic regulatory element and assessing activity as described herein. Similarly, a portion of a polypeptide may be 4 amino acids, 5 amino acids, 6 amino acids, 7 amino acids, and so on, going up to the full length polypeptide. The length of the portion to be used can depend on the particular application. A portion of a nucleic acid useful as a hybridization probe may be as short as 12 nucleotides; in some embodiments, it is 20 nucleotides. A portion of a polypeptide useful as an epitope may be as short as 4 amino acids. A portion of a polypeptide that performs the function of the full-length polypeptide can generally be longer than 4 amino acids.

Variant polynucleotides also encompass sequences that can be derived from a mutagenic and recombinogenic procedure such as DNA shuffling. Strategies for such DNA shuffling are known in the art. See, for example, Stemmer (1994) PNAS 91:10747-10751; Stemmer (1994) Nature 370:389-391; Crameri et al. (1997) Nature Biotech. 15:436-438; Moore et al. (1997) J. Mol. Biol. 272:336-347; Zhang et al. (1997) PNAS 94:4504-4509; Crameri et al. (1998) Nature 391:288-291; and U.S. Pat. Nos. 5,605,793 and 5,837,458.

For PCR amplifications of the polynucleotides disclosed herein, oligonucleotide primers can be designed for use in PCR reactions to amplify corresponding DNA sequences from cDNA or genomic DNA extracted from any organism of interest. Methods for designing PCR primers and PCR cloning are generally known in the art and are disclosed in Sambrook et al. (2001) Molecular Cloning: A Laboratory Manual ($3^{rd}$ ed., Cold Spring Harbor Laboratory Press, Plainview, N.Y.). See also Innis et al., eds. (1990) PCR Protocols: A Guide to Methods and Applications (Academic Press, New York); Innis and Gelfand, eds. (1995) PCR Strategies (Academic Press, New York); and Innis and Gelfand, eds. (1999) PCR Methods Manual (Academic Press, New York). Known methods of PCR can include, but are not limited to, methods using paired primers, nested primers, single specific primers, degenerate primers, gene-specific primers, vector-specific primers, partially-mismatched primers, and the like.

The term "primer" as used herein can refer to an oligonucleotide which is capable of annealing to the amplification target allowing a DNA polymerase to attach, thereby serving as a point of initiation of DNA synthesis when placed under conditions in which synthesis of primer extension product is induced, i.e., in the presence of nucleotides and an agent for polymerization such as DNA polymerase and at a suitable temperature and pH. The (amplification) primer is preferably single stranded for maximum efficiency in amplification. Preferably, the primer is an oligodeoxyribonucleotide. The primer must be sufficiently long to prime the synthesis of extension products in the presence of the agent for polymerization. The exact lengths of the primers will depend on many factors, including temperature and composition (A/T vs. G/C content) of primer. A pair of bi-directional primers consists of one forward and one reverse primer as commonly used in the art of DNA amplification such as in PCR amplification.

As used herein, "promoter" or "promoter polynucleotide" can refer to a DNA sequence capable of controlling the expression of a coding sequence or functional RNA. The promoter sequence consists of proximal and more distal upstream elements, the latter elements can often be referred to as enhancers. Accordingly, an "enhancer" can be a DNA sequence that can stimulate promoter activity, and may be an innate element of the promoter or a heterologous element inserted to enhance the level or tissue specificity of a promoter. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental conditions. It is further recognized that since in most cases the exact boundaries of regulatory sequences have not been completely defined, DNA fragments of some variation may have identical promoter activity.

As used herein, the phrases "recombinant construct", "expression construct", "chimeric construct", "construct", and "recombinant DNA construct" can be used interchangeably herein. A recombinant construct comprises an artificial combination of nucleic acid fragments, e.g., regulatory and coding sequences that are not found together in nature. For example, a chimeric construct may comprise regulatory sequences and coding sequences that are derived from different sources, or regulatory sequences and coding sequences derived from the same source, but arranged in a manner different than that found in nature. In some cases, a chimeric construct can be a recombinant construct comprising a plurality of regulatory (e.g., promoter) and coding sequences (e.g., gapA/transhydrogenase/gdh, asd, dapB, and/or ddh genes). Each coding sequence in a chimeric construct comprising a plurality of coding sequences can be controlled by or functionally linked to a separate regulatory sequence). Such constructs described herein may be used by itself or may be used in conjunction with a vector. If a vector is used then the choice of vector can be dependent upon the method that will be used to transform host cells as is well known to those skilled in the art. For example, a plasmid vector can be used. The skilled artisan is well aware of the genetic elements that must be present on the vector in order to successfully transform, select and propagate host cells comprising any of the isolated nucleic acid fragments of the disclosure. The skilled artisan will also recognize that different independent transformation events will result in different levels and patterns of expression (Jones et al., (1985) EMBO J. 4:2411-2418; De Almeida et al., (1989) Mol. Gen. Genetics 218:78-86), and thus that multiple events must be screened in order to obtain lines displaying the desired expression level and pattern. Such screening may be accomplished by Southern analysis of DNA, Northern analysis of mRNA expression, immunoblotting analysis of protein expression, or phenotypic analysis, among others. Vectors can be plasmids, viruses, bacteriophages, pro-viruses, phagemids, transposons, artificial chromosomes, and the like, that replicate autonomously or can integrate into a chromosome of a host cell. A vector can also be a naked RNA polynucleotide, a naked DNA polynucleotide, a polynucleotide composed of both DNA and RNA within the same strand, a poly-lysine-conjugated DNA or RNA, a peptide-conjugated DNA or RNA, a liposome-conjugated DNA, or the like, that is not autonomously replicating. As used herein, the term "expression" refers to the production of a functional end-product e.g., an mRNA or a protein (precursor or mature).

"Operably linked" or "functionally linked" can mean in this context the sequential arrangement of the promoter polynucleotide according to the disclosure with a further oligo- or polynucleotide (e.g., gapA/transhydrolase/gdh, asd, dapB, and/or ddh gene), resulting in transcription of said further polynucleotide (e.g., gapA/transhydrolase/gdh, asd, dapB, and/or ddh). In other words, "operably linked" or "functionally linked" can mean the promoter controls the transcription of the gene (e.g. gapA/transhydrolase/gdh, asd, dapB, and/or ddh gene) adjacent or downstream or 3' to said promoter.

The term "product of interest" or "biomolecule" as used herein refers to any product produced by microbes from feedstock. In some cases, the product of interest may be a small molecule, enzyme, peptide, amino acid, organic acid, synthetic compound, fuel, alcohol, etc. For example, the product of interest or biomolecule may be any primary or secondary extracellular metabolite. The primary metabolite may be, inter alia, ethanol, citric acid, lactic acid, glutamic acid, glutamate, lysine, threonine, tryptophan and other amino acids, vitamins, polysaccharides, etc. The secondary metabolite may be, inter alia, an antibiotic compound like penicillin, or an immunosuppressant like cyclosporin A, a plant hormone like gibberellin, a statin drug like lovastatin, a fungicide like griseofulvin, etc. The product of interest or biomolecule may also be any intracellular component produced by a microbe, such as: a microbial enzyme, including: catalase, amylase, protease, pectinase, glucose isomerase, cellulase, hemicellulase, lipase, lactase, streptokinase, and many others. The intracellular component may also include recombinant proteins, such as: insulin, hepatitis B vaccine, interferon, granulocyte colony-stimulating factor, streptokinase and others.

The term "carbon source" generally can refer to a substance suitable to be used as a source of carbon for cell growth. Carbon sources can include, but are not limited to, biomass hydrolysates, starch, sucrose, cellulose, hemicellulose, xylose, and lignin, as well as monomeric components of these substrates. Carbon sources can comprise various organic compounds in various forms, including, but not limited to polymers, carbohydrates, acids, alcohols, aldehydes, ketones, amino acids, peptides, etc. These can include, for example, various monosaccharides such as glucose, dextrose (D-glucose), maltose, oligosaccharides, polysaccharides, saturated or unsaturated fatty acids, succinate, lactate, acetate, ethanol, etc., or mixtures thereof. Photosynthetic organisms can additionally produce a carbon source as a product of photosynthesis. In some embodiments, carbon sources may be selected from biomass hydrolysates and glucose.

The term "feedstock" can be defined as a raw material or mixture of raw materials supplied to a microorganism or fermentation process from which other products can be made. For example, a carbon source, such as biomass or the carbon compounds derived from biomass can be a feedstock for a microorganism that produces a product of interest (e.g. small molecule, peptide, synthetic compound, fuel, alcohol, etc.) in a fermentation process. However, a feedstock may contain nutrients other than a carbon source.

The term "volumetric productivity" or "production rate" can be defined as the amount of product formed per volume of medium per unit of time. Volumetric productivity can be reported in gram per liter per hour (g/L/h).

The term "specific productivity" can defined as the rate of formation of the product. To describe productivity as an inherent parameter of the microorganism and not of the fermentation process, productivity can herein further be defined as the specific productivity in gram product per gram of cell dry weight (CDW) per hour (g/g CDW/h). Using the relation of CDW to $OD_{600}$ for the given microorganism specific productivity can also be expressed as gram product per liter culture medium per optical density of the culture broth at 600 nm (OD) per hour (g/L/h/OD)

The term "yield" can be defined as the amount of product obtained per unit weight of raw material and may be expressed as g product per g substrate (g/g). Yield may be expressed as a percentage of the theoretical yield. "Theoretical yield" is defined as the maximum amount of product that can be generated per a given amount of substrate as dictated by the stoichiometry of the metabolic pathway used to make the product.

The term "titre" or "titer" can be defined as the strength of a solution or the concentration of a substance in solution. For example, the titre of a product of interest (e.g. small molecule, peptide, synthetic compound, fuel, alcohol, etc.) in a fermentation broth can be described as g of product of interest in solution per liter of fermentation broth (g/L).

The term "total titer" can be defined as the sum of all product of interest produced in a process, including but not limited to the product of interest in solution, the product of interest in gas phase if applicable, and any product of interest removed from the process and recovered relative to the initial volume in the process or the operating volume in the process.

As used herein, the term "HTP genetic design library" or "library" refers to collections of genetic perturbations according to the present disclosure. In some embodiments, the libraries of the present disclosure may manifest as i) a collection of sequence information in a database or other computer file, ii) a collection of genetic constructs encoding for the aforementioned series of genetic elements, or iii) host cell strains comprising said genetic elements.

Generating Genetic Diversity Pools for Utilization in the Genetic Design & HTP Microbial Engineering Platform to Increase NADPH In some embodiments, the methods of the present disclosure are characterized as genetic design. As used herein, the term genetic design refers to the reconstruction or alteration of a host organism's genome through the identification and selection of the most optimum variants of a particular gene, portion of a gene, promoter, stop codon, 5'UTR, 3'UTR, or other DNA sequence to design and create new superior host cells.

In some embodiments, a first step in the genetic design methods of the present disclosure is to obtain an initial genetic diversity pool population with a plurality of sequence variations from which a new host genome may be reconstructed.

Harnessing Diversity Pools from Existing Wild-Type Strains

In some embodiments, the present disclosure teaches methods for identifying the sequence diversity present among microbes of a given wild-type population. Therefore, a diversity pool can be a given number n of wild-type microbes utilized for analysis, with said microbes' genomes representing the "diversity pool."

In some embodiments, the diversity pools can be the result of existing diversity present in the natural genetic variation among said wild-type microbes. This variation may result from strain variants of a given host cell or may be the result of the microbes being different species entirely. Genetic variations can include any differences in the genetic sequence of the strains, whether naturally occurring or not. In aspects, the disclosure utilizes a proprietary library of microbes to derive novel threonine aldolases. As will be seen, the current application teaches how to utilize this library of threonine aldolases to optimize strain production of this valuable amino acid.

Harnessing Diversity Pools from Existing Industrial Strain Variants

In other embodiments of the present disclosure, diversity pools are strain variants created during traditional strain improvement processes (e.g., one or more host organism strains generated via random mutation and selected for improved yields over the years). Thus, in some embodiments, the diversity pool or host organisms can comprise a collection of historical production strains.

In particular aspects, a diversity pool may be an original parent microbial strain ($S_1$) with a "baseline" genetic sequence at a particular time point ($S_1Gen_1$) and then any number of subsequent offspring strains ($S_2$, $S_3$, $S_4$, $S_5$, etc., generalizable to $S_{2-n}$) that were derived/developed from said $S_1$ strain and that have a different genome ($S_{2-n}Gen_{2-n}$), in relation to the baseline genome of $S_1$.

Creating Diversity Pools Via Mutagenesis

In some embodiments, the mutations of interest in a given diversity pool population of cells can be artificially generated by any means for mutating strains, including mutagenic chemicals, or radiation. The term "mutagenizing" is used herein to refer to a method for inducing one or more genetic modifications in cellular nucleic acid material.

The term "genetic modification" refers to any alteration of DNA. Representative gene modifications include nucleotide insertions, deletions, substitutions, and combinations thereof, and can be as small as a single base or as large as tens of thousands of bases. Thus, the term "genetic modification" encompasses inversions of a nucleotide sequence and other chromosomal rearrangements, whereby the position or orientation of DNA comprising a region of a chromosome is altered. A chromosomal rearrangement can comprise an intrachromosomal rearrangement or an interchromosomal rearrangement.

In one embodiment, the mutagenizing methods employed in the presently claimed subject matter are substantially random such that a genetic modification can occur at any available nucleotide position within the nucleic acid material to be mutagenized. Stated another way, in one embodiment, the mutagenizing does not show a preference or increased frequency of occurrence at particular nucleotide sequences.

The methods of the disclosure can employ any mutagenic agent including, but not limited to: ultraviolet light, X-ray radiation, gamma radiation, N-ethyl-N-nitrosourea (ENU), methyinitrosourea (MNU), procarbazine (PRC), triethylene melamine (TEM), acrylamide monomer (AA), chlorambucil (CHL), melphalan (MLP), cyclophosphamide (CPP), diethyl sulfate (DES), ethyl methane sulfonate (EMS), methyl methane sulfonate (MMS), 6-mercaptopurine (6-MP), mitomycin-C(MMC), N-methyl-N'-nitro-N-nitrosoguanidine (MNNG), $^3H_2O$, and urethane (UR) (See e.g., Rinchik, 1991; Marker et al., 1997; and Russell, 1990). Additional mutagenic agents are well known to persons having skill in the art, including those described in http://www.iephb.nw.ru/~spirov/hazard/mutagen_lst.html.

The term "mutagenizing" also encompasses a method for altering (e.g., by targeted mutation) or modulating a cell function, to thereby enhance a rate, quality, or extent of mutagenesis. For example, a cell can be altered or modulated to thereby be dysfunctional or deficient in DNA repair, mutagen metabolism, mutagen sensitivity, genomic stability, or combinations thereof. Thus, disruption of gene functions that normally maintain genomic stability can be used to enhance mutagenesis. Representative targets of disruption include, but are not limited to DNA ligase I (Bentley et al., 2002) and casein kinase I (U.S. Pat. No. 6,060,296).

In some embodiments, site-specific mutagenesis (e.g., primer-directed mutagenesis using a commercially available kit such as the Transformer Site Directed mutagenesis kit (Clontech)) is used to make a plurality of changes throughout a nucleic acid sequence in order to generate nucleic acid encoding a cleavage enzyme of the present disclosure.

The frequency of genetic modification upon exposure to one or more mutagenic agents can be modulated by varying dose and/or repetition of treatment, and can be tailored for a particular application.

Thus, in some embodiments, "mutagenesis" as used herein comprises all techniques known in the art for inducing mutations, including error-prone PCR mutagenesis, oligonucleotide-directed mutagenesis, site-directed mutagenesis, and iterative sequence recombination by any of the techniques described herein.

Overview of Genetic Design to Increase NADPH

The present disclosure provides a method for generating a microorganism (e.g., bacteria) that is capable of increased production of a biomolecule or product of interest. In general, the methods for generating a microorganism for use in producing any biomolecule as provided herein can entail genetically modifying a host microorganism by introducing one or more target genes into said host microorganism to generate a genomically engineered strain of said microorganism, culturing said engineered strain under conditions suitable to produce the biomolecule or product of interest, and selecting said engineered strain if said engineered strain produces an increased amount of the biomolecule or product of interest. The increased amount can be as compared to a wild-type strain of the host microorganism. The increased amount can be as compared to a strain of the host microorganism that does not contain a member of the library of target genes. The target genes can comprise a single target gene in a vector, or multiple target gene on the same vector.

An exemplary workflow of one of the embodiments of the disclosure entails identifying a target gene, acquiring or synthesizing nucleic acid (e.g., DNA) for the target gene, and cloning said acquired or synthesized target gene into a suitable vector. Any method known in the art and/or provided herein can be used to assemble or clone the target gene or target genes into a suitable vector. The vector can be any vector known in the art and/or provided herein that is compatible with the host microorganism to be utilized. Once the vector comprising the target gene(s) is assembled, it can be introduced into the host microorganism. The introduction of the vector can be using any method known in the art and/or provided herein. The host microorganism can be any host microorganism provided herein. Once introduced into the host microorganism, genetically modified hosts can be selected and the insertion of the target gene(s) can be evaluated. The target gene(s) can be engineered to be inserted into specific locations of the host microorganism's genome. In some cases, the target gene(s) is inserted into a neutral site of the genome that facilitates expression of the target gene(s) without perturbing unintended pathways/processes within the host microorganism. In some cases, the target gene(s) replace specific gene(s) within the host microorganism. The specific gene can be the homologous target gene normally present in the host microorganism. The integration site, such as, for example, the neutral integration site can be determined empirically such that various sites can tested and a site that permits expression of the integrated target gene(s) without being detrimental to the host cell can be chosen. Integration into a desired site (e.g., neutral site) can be facilitated by cloning the target gene(s) into a vector comprising portions of sequence homologous to the desired integration site (i.e., homologous arms) and subsequently performing a recombination event in the host cell. The target gene(s) can be inserted between the portions of homologous sequence. In certain embodiments, the vector comprises about 2 kb of sequence homologous to the desired integration site. The sequence homologous to the desired site can flank a Glyceraldehyde-3-phosphate dehydrogenase (gapA), glutamate dehydrogenase (gdh), aspartate semialdehyde dehydrogenase (asd), dihydropicolinate reductase (dapB), and/or meso-diaminopimelate dehydrogenase (ddh) gene insert such that a first portion of the sequence is upstream (i.e., 5') of the gene insert and a second portion of the sequence is downstream (i.e., 3') of the gene insert. In other embodiments, the vector comprises about 4 kb of sequence homologous to the desired integration site. In this embodiment, the vector comprises about 2 kb of sequence homologous to the desired integration site upstream (i.e., 5') to a gapA, gdh, asd, dapB, and/or ddh gene insert and about 2 kb of sequence homologous to the desired integration site downstream (i.e., 3') to a gapA, gdh, asd, dapB, and/or ddh gene insert. In some embodiments, integration is performed by a single-cross-over integration and subsequent loop out of the plasmid backbone facilitated by counter-selection on a marker present in the vector backbone. In some embodiments, the target gene is any gapA gene known in the art and/or provided herein. In other embodiments, the target gene is any nicotinamide nucleotide transhydrogenase enzyme gene known in the art and/or provided herein. In yet other embodiments, the target genes are any gdh, asd, dapB, and/or ddh genes known in the art and/or provided herein. In some embodiments, target genes are any gapA gene known in the art and/or provided herein, and/or any nicotinamide nucleotide transhydrogenase enzyme gene known in the art and/or provided herein, and/or any gdh, asd, dapB, and ddh gene known in the art and/or provided herein. In yet other embodiments, the target genes are any thrA, thrB, thrC, and/or ltaE genes known in the art and/or provided herein. In yet other embodiments, the target genes are any pyc genes known in the art and/or provided herein.

Evaluation of the insertion can be performed using any method know in the art such as, for example, amplifying and/or sequencing of the genetically modified microorganism's genome or portions thereof. In some cases, the methods provided herein also entail the removal or looping out of selection markers through counter selection as described herein. The looping out can be performed using any of the methods provided herein.

Following the evaluation of the insertion of the target gene(s) and, optional, removal of selection markers, the genetically modified strain can be evaluated for its ability to produce a biomolecule or product of interest. Prior to evaluation an optional step can be expanding the strain. Expansion can entail culturing the genetically modified strain on plates or in wells in a multi-well plate in growth media suitable for expansion. The evaluation step can entail culturing the genetically modified strain on plates or in wells in a multi-well plate comprising growth media/conditions designed to mimic actual conditions for producing a biomolecule or product of interest. In some cases, the growth media in this step is suitable for the production of biomolecules or products of interest derived from the metabolic processing of glucose. If the genetically modified strain possesses or is predicted to produce a desired or threshold rate of production or yield of the biomolecule or product of interest as determined from the evaluation step, the strain can be selected and placed in cold storage. The prediction can be based on measuring the amount of product of interest and biomass formed at various time points during culturing of the strain and using said measurements to predict how said strain will perform under expanded or larger scale conditions (e.g., fermentation conditions). In one embodiment, the prediction is based on a linear regression analysis of the performance of the strain during the evaluation method.

In some cases, a genetically modified strain possessing or predicted to produce a desired or threshold rate of production or yield of the biomolecule or product of interest is transferred to or grown in a larger culture under conditions for producing the biomolecule or product of interest (e.g., fermentation conditions). This step can be used in order to determine if the selected strain can perform as predicted under actual conditions for the production of the biomolecule or product of interest. In some cases, the steps provided herein for the introduction and evaluation of each target gene from a library of target genes such as those provided herein are repeated for each target gene from the library in order to select one or more strains of genetically modified microorganisms that produce a desired or threshold yield and/or productivity rate of a biomolecule or product of interest.

In some embodiments, the biomolecule or product of interest is derived from glucose and the metabolic processing thereof by the microorganism such that the methods provided herein entail the generation of a strain or strains of microorganisms that produce an increased amount of a biomolecule or product of interest derived from the metabolic processing of glucose by the strain or strains. In certain embodiments, the methods provided herein entail the introduction of one or more target genes involved in lysine biosynthesis. In other embodiments, the methods provided herein entail the introduction of one or more target genes involved in NADPH production in the host cell. In yet other embodiments, the methods provided herein entail the introduction of one or more target genes involved in reducing NADPH utilization by the host cell. In some embodiments, the target gene is a gapA gene such that a gapA gene is introduced into the host microorganism in the methods provided herein. The gapA gene can be a heterologous gene in the host microorganism.

In other embodiments, the target gene is a nicotinamide nucleotide transhydrogenase gene such that a nicotinamide nucleotide transhydrogenase gene is introduced into the host microorganism in the methods provided herein.

In many organisms, tricarboxylic acid (TCA) cycle intermediates can be regenerated directly from pyruvate. For example, pyruvate carboxylase (pyc), which is found in some bacteria but not *E. coli*, mediates the formation of oxaloacetate by the carboxylation of pyruvate utilizing carboxybiotin.

In other embodiments, the target gene is a pyruvate carboxylase gene such that a pyruvate carboxylase (pyc) gene is introduced into the host microorganism in the methods provided herein. The pyc gene can be heterologous to the host microorigamsm. In certain embodiments, the pyc gene is selected from the sequences disclosed in U.S. Pat. Nos. 6,171,833 and 6,171,833. In one embodiment, the pyc gene is derived from *R. etli*. In one embodiment, the pyc gene is derived from a *Corynebacterium*. In one embodiment, the target organism is *E. coli*. In one embodiment, the target organism is *Corynebacterium* sp. In one embodiment, a heterologous variant of pyc is expressed in a host cell that lacks an endogenous pyc. In one embodiment, a heterologous variant of pyc is expressed in a host cell that has an endogenous pyc. In one embodiment, the expression of an endogenous pyc is increased by genetically modifying the locus comprising pyc to include a strong promoter operatively linked to pyc. In some embodiments, expression of pyc is modulated by selecting a promoter from a promoter ladder. In one embodiment, the expression of native PYC is increased by inserting a promoter element operatively linked to the native pyc gene. In one embodiment, the expression of native PYC is tuned by inserting each of several promoter elements from a promoter ladder, operatively linked to the native pyc gene. In one embodiment, the expression of PYC is increased by overexpression of heterologous pyc gene. In one embodiment, the heterologous pyc gene is a *C. glutamicum* pyc gene. In one embodiment, the *C. glutamicum* pyc is operatively linked to a strong promoter. In one embodiment, the *C. glutamicum* pyc is operatively linked to each of several promoter elements from a promoter ladder and expression of PYC is tuned by selection of the promoter element yielding the highest amount of the desired product, e.g. threonine.

In yet other embodiments, the target gene is a one or more of a gdh, asd, dapB, or ddh gene such that a gdh, asd, dapB, or ddh gene is introduced into the host microorganism in the methods provided herein. One or more of the gdh, asd, dapB, or ddh gene can be a heterologous gene in the host microorganism. In certain embodiments, all four genes gdh, asd, dapB, and ddh are introduced into the host microorganism in the methods provided herein.

In certain embodiments, both a gapA gene and a nicotinamide nucleotide transhydrogenase gene are introduced into the host microorganism in the methods provided herein.

In other embodiments, a gapA gene as well as one or more genes selected from gdh, asd, dapB, and ddh are introduced into the host microorganism in the methods provided herein. In yet other embodiments, a nicotinamide nucleotide transhydrogenase gene as well as one or more genes selected from gdh, asd, dapB, and ddh are introduced into the host microorganism in the methods provided herein.

In still other embodiments, a gapA, a nicotinamide nucleotide transhydrogenase gene, and one or more genes selected from gdh, asd, dapB, and ddh are simultaneously introduced into the host microorganism in the methods provided herein.

In one embodiment, the introduction of a gapA gene, and/or a nicotinamide nucleotide transhydrogenase gene, and/or one or more genes selected from gdh, asd, dapB, and ddh, and/or a TA gene, and/or a pyc gene into the host microorganism increases the amount of NADPH in the host microorganism. In certain aspects, the production of NADPH is increased in the host microorganism. In other aspects, the utilization of NADPH is reduced in the host microorganism. In certain embodiments, the increased amount of NADPH in the host microorganism serves to increase the synthesis of biomolecules or products of interest. The biomolecules or products of interest produced by the methods provided herein can be any commercial product produced from glucose. In some cases, the biomolecule or product of interest is a small molecule, an amino acid, an organic acid, or an alcohol. The amino acid can be tyrosine, phenylalanine, tryptophan, aspartic acid, asparagine, threonine, isoleucine, methionine, or lysine. The organic acid can be succinate, lactate or pyruvate. The alcohol can be ethanol or isobutanol. In specific embodiments, the biomolecule or product of interest is an amino acid. In specific aspects, the amino acid is lysine. In certain aspects, the lysine is L-lysine. In specific aspects, the amino acid is threonine. In certain aspects, the threonine is L-threonine.

In one embodiment, the host strain is a bacterial strain that has been modified by insertion a thrLABC regulon (e.g. the thrLABC regulon of *E. coli* K-12 strain W3110 (SEQ ID NO. 76)). In one embodiment, the host strain is a bacterial strain that has been modified by insertion a thrABC regulon (e.g. the thrLABC regulon of *E. coli* K-12 strain W3110 modified by deletion of the thrL leader sequence (SEQ ID NO: 77)). In one embodiment, the host strain is a bacterial strain that has been modified by deletion of the region of the bacterial genome encoding L-threonine 3-dehydrogenase (tdh) or homolog(s) thereof.

Microbial Genetic Engineering Utilizing Libraries to Increase NADPH

In one embodiment, the disclosed microbial genomic engineering method utilizes a library of gapA gene, and/or a nicotinamide nucleotide transhydrogenase gene, and/or one or more genes selected from gdh, asd, dapB, and ddh, and/or a TA gene, and/or a pyc gene. A gapA gene can be selected based on its ability to use NAD as a cofactor. In certain embodiments, the coenzyme specificity of gapA is broadened. Thus, in some aspects, the gapA has dual specificity for NAD and NADH. In some aspects, the gapA uses NADH more preferentially than NAD. In other aspects, the gapA has equal preference for NAD and NADH. A nicotinamide nucleotide transhydrogenase gene can be selected based on its ability to convert NADH to NADPH. A gdh, asd, dapB, or ddh can be selected based on its ability to use NADPH as a cofactor. In certain embodiments, the coenzyme specificity of gdh, asd, dapB, and/or ddh is broadened. Thus, in some aspects, the gdh, asd, dapB, and/or ddh has dual specificity for NADPH and NADP. In some aspects, the gdh, asd, dapB, and/or ddh uses NADPH more preferentially than NADP. In other aspects, the gdh, asd, dapB, and/or ddh has equal preference for NADPH and NADP. A TA gene can be selected based on its ability to metabolize threonine more slowly or to produce threonine. In certain embodiments, the substrate specificity of TA is broadened. Thus, in some aspects, the TA has dual specificity for glycine and serine. In some aspects, the TA uses serine more preferentially than glycine. In other aspects, the TA has equal preference for serine and glycine. A pyc can be selected based on its ability to convert pyruvate to oxaloacete.

In some cases, the microbes are engineered utilizing a gapA library, a nicotinamide nucleotide transhydrogenase library, a gdh, asd, dapB, and/or ddh, and/or a TA library, and/or a pyc library or any combinations of these libraries. In some embodiments, the library contains a plurality of chimeric construct inserts such that each insert in the library comprises a gapA gene, a nicotinamide nucleotide transhydrogenase gene, and one or more genes selected from gdh, asd, dapB, and ddh, and/or a TA gene, and/or a pyc gene. Following engineering, the microbes can be efficiently screened or evaluated for resultant outcome, e.g. production of a product from glucose as provided herein. This process of utilizing the libraries provided herein to define particular genomic alterations and then testing/screening host microbial genomes harboring the alterations can be implemented in an efficient and iterative manner and can be used to identify specific combinations of gapA and/or nicotinamide nucleotide transhydrogenase gene, and/or one or more genes selected from gdh, asd, dapB, and ddh, and/or a TA gene, and/or a pyc gene, whose expression in a host cell produces a desired or threshold level of a biomolecule or product of interest form glucose.

In certain embodiments, each gapA gene or nicotinamide nucleotide transhydrogenase gene, or one or more genes selected from gdh, asd, dapB, and ddh as provided herein for use in the methods provided herein is under the control of or functionally linked to a native promoter or any of the promoter polynucleotides provided herein. A "promoter polynucleotide" or a "promoter" or a "polynucleotide having promoter activity" can mean a polynucleotide, preferably deoxyribopolynucleotide, or a nucleic acid, preferably deoxyribonucleic acid (DNA), which when functionally linked to a polynucleotide to be transcribed determines the point and frequency of initiation of transcription of the coding polynucleotide (e.g., gapA gene or nicotinamide nucleotide transhydrogenase gene, or one or more genes selected from gdh, asd, dapB, and ddh, and/or a TA gene, and/or a pyc gene), thereby enabling the strength of expression of the controlled polynucleotide to be influenced. In some embodiments, each gapA gene and/or nicotinamide nucleotide transhydrogenase gene, and/or one or more genes selected from gdh, asd, dapB, and ddh, and/or a TA gene, and/or a pyc gene in a library comprising gapA genes and/or nicotinamide nucleotide transhydrogenase genes and/or one or more genes selected from gdh, asd, dapB, and ddh, and/or a TA gene, and/or a pyc gene is under the control of the same or an identical promoter. In other embodiments, each gapA gene and/or nicotinamide nucleotide transhydrogenase and/or one or more genes selected from gdh, asd, dapB, and ddh, and/or a TA gene, and/or a pyc gene in a library comprising glucose gapA genes and/or nicotinamide nucleotide transhydrogenase genes and/or one or more genes selected from gdh, asd, dapB, and ddh, and/or a TA gene, and/or a pyc gene is under the control of separate or different promoter. In yet other embodiments, each target gene in a chimeric construct in a library of chimeric constructs comprising the target genes are under the control of the same or an identical promoter. In further embodiments, each target gene in a chimeric construct in a library of chimeric constructs comprising the target genes are under the control of a separate or different promoter.

Promoter Ladders

In some embodiments, the present disclosure teaches methods of selecting promoters with optimal expression properties to modulate expression of one or more enzymes in a host microbe, and produce beneficial effects on overall-host strain productivity.

Promoters regulate the rate at which genes are transcribed and can influence transcription in a variety of ways. Constitutive promoters, for example, direct the transcription of their associated genes at a constant rate regardless of the internal or external cellular conditions, while regulatable promoters increase or decrease the rate at which a gene is transcribed depending on the internal and/or the external cellular conditions, e.g. growth rate, temperature, responses to specific environmental chemicals, and the like. Promoters can be isolated from their normal cellular contexts and engineered to regulate the expression of virtually any gene, enabling the effective modification of cellular growth, product yield and/or other phenotypes of interest.

In some embodiments, the present disclosure teaches methods for producing promoter ladder libraries for use in downstream genetic design methods. For example, in some embodiments, the present disclosure teaches methods of identifying one or more promoters and/or generating variants of one or more promoters within a host cell, which exhibit a range of expression strengths, or superior regulatory properties. A particular combination of these identified and/or generated promoters can be grouped together as a promoter ladder, which is explained in more detail below.

In some embodiments, the present disclosure teaches the use of promoter ladders. In some embodiments, the promoter ladders of the present disclosure comprise promoters exhibiting a continuous range of expression profiles. For example, in some embodiments, promoter ladders are created by: identifying natural, native, or wild-type promoters that exhibit a range of expression strengths in response to a stimuli, or through constitutive expression. These identified promoters can be grouped together as a promoter ladder.

In other embodiments, the present disclosure teaches the creation of promoter ladders exhibiting a range of expression profiles across different conditions. For example, in some embodiments, the present disclosure teaches creating a ladder of promoters with expression peaks spread throughout the different stages of a fermentation. In other embodiments, the present disclosure teaches creating a ladder of promoters with different expression peak dynamics in response to a specific stimulus. Persons skilled in the art will recognize that the regulatory promoter ladders of the present disclosure can be representative of any one or more regulatory profiles.

In some embodiments, the promoter ladders of the present disclosure are designed to perturb gene expression in a predictable manner across a continuous range of responses. In some embodiments, the continuous nature of a promoter ladder confers strain improvement programs with additional predictive power. For example, in some embodiments, swapping promoters or termination sequences of a selected metabolic pathway can produce a host cell performance curve, which identifies the most optimum expression ratio or profile; producing a strain in which the targeted gene is no longer a limiting factor for a particular reaction or genetic cascade, while also avoiding unnecessary over expression or misexpression under inappropriate circumstances. In some embodiments, promoter ladders are created by: identifying natural, native, or wild-type promoters exhibiting the desired profiles. In other embodiments, the promoter ladders are created by mutating naturally occurring promoters to derive multiple mutated promoter sequences. Each of these mutated promoters is tested for effect on target gene expression. In some embodiments, the edited promoters are tested for expression activity across a variety of conditions, such that each promoter variant's activity is documented/characterized/annotated and stored in a database. The resulting edited promoter variants are subsequently organized into promoter ladders arranged based on the strength of their expression (e.g., with highly expressing variants near the top, and attenuated expression near the bottom, therefore leading to the term "ladder").

In some embodiments, the present disclosure teaches promoter ladders that are a combination of identified naturally occurring promoters and mutated variant promoters.

In some embodiments, the present disclosure teaches methods of identifying natural, native, or wild-type promoters that satisfied both of the following criteria: 1) represented a ladder of constitutive promoters; and 2) could be encoded by short DNA sequences, ideally less than 100 base pairs. In some embodiments, constitutive promoters of the present disclosure exhibit constant gene expression across two selected growth conditions (typically compared among conditions experienced during industrial cultivation). In some embodiments, the promoters of the present disclosure will consist of a ~60 base pair core promoter, and a 5' UTR between 26- and 40 base pairs in length.

In some embodiments, one or more of the aforementioned identified naturally occurring promoter sequences are chosen for gene editing. In some embodiments, the natural promoters are edited via any of the mutation methods described supra. In other embodiments, the promoters of the present disclosure are edited by synthesizing new promoter variants with the desired sequence.

The entire disclosure of the following applications are incorporated herein by reference: U.S. application Ser. No. 15/396,230 (U.S. Pub. No. US 2017/0159045 A1); PCT/US2016/065465 (WO 2017/100377 A1); U.S. application Ser. No. 15/140,296 (US 2017/0316353 A1); PCT/US2017/029725 (WO 2017/189784 A1); PCT/US2016/065464 (WO 2017/100376 A2); U.S. Prov. App. No. 62/431,409; U.S. Prov. App. No. 62/264,232; and U.S. Prov. App. No. 62/368,786.

A non-exhaustive list of the promoters of the present disclosure is provided in the below Table 1. Each of the promoter sequences can be referred to as a heterologous promoter or heterologous promoter polynucleotide.

TABLE 1

Selected promoter sequences of the present disclosure.

| SEQ ID No. | Promoter Short Name | Promoter Name |
|---|---|---|
| 59 | P1 | Pcg0007_lib_39 |
| 60 | P2 | Pcg0007 |
| 61 | P3 | Pcg1860 |
| 62 | P4 | Pcg0755 |
| 63 | P5 | Pcg0007_265 |
| 64 | P6 | Pcg3381 |
| 65 | P7 | Pcg0007_119 |
| 66 | P8 | Pcg3121 |

In some embodiments, the promoters of the present disclosure exhibit at least 100%, 99%, 98%, 97%, 96%, 95%, 94%, 93%, 92%, 91%, 90%, 89%, 88%, 87%, 86%, 85%, 84%, 83%, 82%, 81%, 80%, 79%, 78%, 77%, 76%, or 75% sequence identity with a promoter from the above table.

In some cases, the promoter ladder can be utilized in front of a gene selected from a gapA library, a nicotinamide nucleotide transhydrogenase library, a gdh, asd, dapB, and/or ddh, and/or a TA library, and/or a pyc library, or any combinations of these libraries. In some embodiments, use of the promoter ladder comprises modulating expression of a gene selected from a gapA library, a nicotinamide nucleotide transhydrogenase library, a gdh, asd, dapB, and/or ddh, and/or a TA library, and/or a pyc library, or any combinations of these libraries. In some embodiments, use of the promoter ladder comprises fine-tuning expression of a gene selected from a gapA library, a nicotinamide nucleotide transhydrogenase library, a gdh, asd, dapB, and/or ddh, and/or a TA gene, and/or a pyc gene, or any combinations of these libraries. Following engineering, the microbes can be efficiently screened or evaluated for resultant outcome, e.g. production of a product from glucose as provided herein. This process of utilizing the promoter ladders provided herein to generate hosts in which a gene achieves a particular expression level and then testing/screening host microbial genomes harboring the alterations can be implemented in an efficient and iterative manner and can be used to identify specific gene expression levels optimal for a gapA and/or nicotinamide nucleotide transhydrogenase gene, and/or one or more genes selected from gdh, asd, dapB, and ddh, and/or a TA gene, and/or a pyc gene, whereby expression at that gene expression level in a host cell produces a desired or threshold level of a biomolecule or product of interest form glucose.

Glyceraldehyde-3-Phosphate Dehydrogenase Library

In certain embodiments is provided herein a library of gapA genes for use in the methods provided herein. The library of gapA genes can comprise one or more gapA genes. Each gapA gene in the library can be a native form of the gapA gene or a mutated form. The mutated form can comprise one or more mutations selected from an insertion, deletion, single nucleotide polymorphism (SNP), or translocation. Each gapA gene in the library can be a gapA gene. The gapA gene can be any gapA gene from a prokaryotic cell (i.e., Bacteria and/or Archaea) known in the art. The gapA gene can be any gapA gene from a eukaryotic cell (e.g., fungal) known in the art. A gapA can be considered any protein comprising NAD- and/or NADH-dependent GAPDH activity. For example, a gapA for use herein can be any enzyme that converts glyceraldehyde-3-phosphate to glycerate-1,3-bisphosphate. The host cell can be any host cell provided herein. In some embodiments, the library of gapA genes comprises gapA genes from any strain/species/sub-species of *Mycobacterium* (e.g., *Mycobacterium smegmatis*), *Streptomyces* (e.g., *Streptomyces coelicolor*), *Zymomonas* (e.g., *Zymomonas mobilis*), *Synechocystis* (e.g., *Synechocystis* sp. PCC6803), *Bifidobacterium* (e.g., *Bifidobacterium longum*), *Escherichia* (e.g., *Escherichia coli*), *Bacillus* (e.g., *Bacillus subtilis*), *Corynebacterium* (e.g., *Corynebacterium glutamicum*), *Saccharomyces* (e.g., *S. cerevisiae*) or a combination thereof.

In some embodiments, the gapA enzyme of the present disclosure exhibits at least 100%, 99%, 98%, 97%, 96%, 95%, 94%, 93%, 92%, 91%, 90%, 89%, 88%, 87%, 86%, 85%, 84%, 83%, 82%, 81%, 80%, 79%, 78%, 77%, 76%, or 75% sequence identity with a gapA enzyme provided herein.

Each gapA gene in the library can be functionally linked or under the control of its native promoter or a mutated form of its native promoter. Each gapA gene in the library can be functionally linked to or controlled by any promoter provided herein. Each gapA gene in a library of gapA genes can be present in a chimeric construct such that the gene can be flanked by one or more regulatory sequences and/or sequence homologous to sequence present in the genome of a host cell. The sequence homologous to sequence present in the host cell can facilitate integration of the gapA gene into a site or locus of the host cell genome that comprises complementary sequence. Integration can be via a recombination event. The regulatory sequence can be any regulatory sequence known in the art or provided herein such as, for example, a promoter, start, stop, signal, secretion and/or termination sequence used by the genetic machinery of the host cell.

Nicotinamide Nucleotide Transhydrogenase Library

In certain embodiments is provided herein a library of nicotinamide nucleotide transhydrogenase genes for use in the methods provided herein. The library of nicotinamide nucleotide transhydrogenase genes can comprise one or more nicotinamide nucleotide transhydrogenase genes. Each nicotinamide nucleotide transhydrogenase gene in the library can be a native form of the transhydrogenase gene or a mutated form. The mutated form can comprise one or more mutations selected from an insertion, deletion, single nucleotide polymorphism (SNP), or translocation. Each nicotinamide nucleotide transhydrogenase gene in the library can be a transhydrogenase gene. The nicotinamide nucleotide transhydrogenase gene can be any transhydrogenase gene from a prokaryotic cell (i.e., Bacteria and/or Archaea) known in the art. The nicotinamide nucleotide transhydrogenase gene can be any transhydrogenase gene from a eukaryotic cell (e.g., fungal) known in the art. A nicotinamide nucleotide transhydrogenase can be any enzyme that converts NADH to NADPH. The host cell can be any host cell provided herein. In some embodiments, the library of nicotinamide nucleotide transhydrogenase genes comprises transhydrogenase genes from any strain/species/sub-species of *Mycobacterium* (e.g., *Mycobacterium smegmatis*), *Streptomyces* (e.g., *Streptomyces coelicolor*), *Zymomonas* (e.g., *Zymomonas mobilis*), *Synechocystis* (e.g., *Synechocystis* sp. PCC6803), *Bifidobacterium* (e.g., *Bifidobacterium longum*), *Escherichia* (e.g., *Escherichia coli*), *Bacillus* (e.g., *Bacillus subtilis*), *Corynebacterium* (e.g., *Corynebacterium glutamicum*), *Saccharomyces* (e.g., *S. cerevisiae*) or a combination thereof.

In some embodiments, the nicotinamide nucleotide transhydrogenase enzyme of the present disclosure exhibits at least 100%, 99%, 98%, 97%, 96%, 95%, 94%, 93%, 92%, 91%, 90%, 89%, 88%, 87%, 86%, 85%, 84%, 83%, 82%, 81%, 80%, 79%, 78%, 77%, 76%, or 75% sequence identity with a transhydrogenase enzyme provided herein.

Each nicotinamide nucleotide transhydrogenase gene in the library can be functionally linked or under the control of its native promoter or a mutated form of its native promoter. Each nicotinamide nucleotide transhydrogenase gene in the library can be functionally linked to or controlled by any promoter provided herein. Each nicotinamide nucleotide transhydrogenase gene in a library of nicotinamide nucleotide transhydrogenase genes can be present in a chimeric construct such that the gene can be flanked by one or more regulatory sequences and/or sequence homologous to sequence present in the genome of a host cell. The sequence homologous to sequence present in the host cell can facilitate integration of the nicotinamide nucleotide transhydrogenase gene into a site or locus of the host cell genome that comprises complementary sequence. Integration can be via a recombination event. The regulatory sequence can be any regulatory sequence known in the art or provided herein such as, for example, a promoter, start, stop, signal, secretion and/or termination sequence used by the genetic machinery of the host cell.

gdh, asd, dapB and/or ddh Library

In certain embodiments is provided herein a library of gdh, asd, dapB and ddh genes for use in the methods provided herein. The library of gdh, asd, dapB and ddh genes can comprise one or more gdh, asd, dapB and ddh genes. Each gdh, asd, dapB or ddh gene in the library can be a native form of the gdh, asd, dapB or ddh gene, respectively or a mutated form. The mutated form can comprise one or more mutations selected from an insertion, deletion, single nucleotide polymorphism (SNP), or translocation. Each gdh, asd, dapB or ddh gene in the library can be a gdh, asd, dapB or ddh gene, respectively. The gdh, asd, dapB or ddh gene can be any gdh, asd, dapB or ddh gene, respectively from a prokaryotic cell (i.e., Bacteria and/or Archaea) known in the art. The asd, dapB or ddh gene can be any asd, dapB or ddh gene, respectively from a eukaryotic cell (e.g., fungal) known in the art. A gdh can be considered any protein comprising NADPH- and/or NADH-dependent glutamate dehydrogenase activity. For example, a gdh for use herein can be any enzyme that converts oxaloacetate to aspartate. An asd can be considered any protein comprising NADPH- and/or NADH-dependent aspartate semialdehyde dehydrogenase activity. For example, an asd for use herein can be any enzyme that converts aspartyl phosphate to aspartate semialdehyde. A dapB can be considered any protein comprising NADPH- and/or NADH-dependent dihydropicolinate reductase activity. For example, a dapB for use herein can be any enzyme that converts dihydropicolinate to tetrahydropicolinate. A ddh can be considered any protein comprising NADPH- and/or NADH-dependent meso-diaminopimelate dehydrogenase activity. For example, a ddh for use herein can be any enzyme that catalyzes the direct conversion of tetrahydropicolinate to meso-diaminopimelate.

The host cell can be any host cell provided herein. In some embodiments, the library of asd, dapB or ddh genes comprises asd, dapB or ddh genes, respectively from any strain/species/sub-species of *Mycobacterium* (e.g., *Mycobacterium smegmatis*), *Streptomyces* (e.g., *Streptomyces coelicolor*), *Zymomonas* (e.g., *Zymomonas mobilis*), *Synechocystis* (e.g., *Synechocystis* sp. PCC6803), *Bifidobacterium* (e.g., *Bifidobacterium longum*), *Escherichia* (e.g., *Escherichia coli*), *Bacillus* (e.g., *Bacillus subtilis*), *Corynebacterium* (e.g., *Corynebacterium glutamicum*), *Saccharomyces* (e.g., *S. cerevisiae*) or a combination thereof.

In some embodiments, the asd, dapB or ddh enzyme of the present disclosure exhibits at least 100%, 99%, 98%, 97%, 96%, 95%, 94%, 93%, 92%, 91%, 90%, 89%, 88%, 87%, 86%, 85%, 84%, 83%, 82%, 81%, 80%, 79%, 78%, 77%, 76%, or 75% sequence identity with a asd, dapB or ddh enzyme, respectively provided herein.

Each asd, dapB or ddh gene in the library can be functionally linked or under the control of its native promoter or a mutated form of its native promoter. Each asd, dapB or ddh gene in the library can be functionally linked to or controlled by any promoter provided herein. Each asd, dapB and/or ddh gene in a library of asd, dapB and/or ddh genes can be present in a chimeric construct such that the gene can be flanked by one or more regulatory sequences and/or sequence homologous to sequence present in the genome of a host cell. The sequence homologous to sequence present in the host cell can facilitate integration of the asd, dapB or ddh gene into a site or locus of the host cell genome that comprises complementary sequence. Integration can be via a recombination event. The regulatory sequence can be any regulatory sequence known in the art or provided herein such as, for example, a promoter, start, stop, signal, secretion and/or termination sequence used by the genetic machinery of the host cell.

TA Library

In certain embodiments is provided herein a library of TA genes for use in the methods provided herein. The library of TA genes can comprise one or more TA genes. Each TA gene in the library can be a native form of the TA gene, respectively or a mutated form. The mutated form can comprise one or more mutations selected from an insertion, deletion, single nucleotide polymorphism (SNP), or translocation. Each TA gene in the library can be a TA gene, respectively. The TA gene can be any TA gene, respectively from a prokaryotic cell (i.e., Bacteria and/or Archaea) known in the art. The TA gene can be any TA gene, respectively from a eukaryotic cell (e.g., fungal) known in the art. A TA can be considered any protein comprising threonine aldolase activity. For example, a TA for use herein can be any enzyme that converts threonine to acetaldehyde and glycine. In one embodiment, the TA gene converts threonine to acetaldehyde and glycine at a slower rate than endogenous TA. In one embodiment, the TA gene converts acetaldehyde and glycine to threonine.

The host cell can be any host cell provided herein. In some embodiments, the library of TA genes comprises TA genes, respectively from any strain/species/sub-species of *Mycobacterium* (e.g., *Mycobacterium smegmatis*), *Streptomyces* (e.g., *Streptomyces coelicolor*), *Zymomonas* (e.g., *Zymomonas mobilis*), *Synechocystis* (e.g., *Synechocystis* sp. PCC6803), *Bifidobacterium* (e.g., *Bifidobacterium longum*), *Escherichia* (e.g., *Escherichia coli*), *Bacillus* (e.g., *Bacillus subtilis*), *Corynebacterium* (e.g., *Corynebacterium glutamicum*), *Saccharomyces* (e.g., *S. cerevisiae*) or a combination thereof.

In some embodiments, the TA enzyme of the present disclosure exhibits at least 100%, 99%, 98%, 97%, 96%, 95%, 94%, 93%, 92%, 91%, 90%, 89%, 88%, 87%, 86%, 85%, 84%, 83%, 82%, 81%, 80%, 79%, 78%, 77%, 76%, or 75% sequence identity with a TA enzyme, respectively provided herein.

Each TA gene in the library can be functionally linked or under the control of its native promoter or a mutated form of its native promoter. Each TA gene in the library can be functionally linked to or controlled by any promoter provided herein. Each TA gene in a library of TA genes can be present in a chimeric construct such that the gene can be flanked by one or more regulatory sequences and/or sequence homologous to sequence present in the genome of a host cell. The sequence homologous to sequence present in the host cell can facilitate integration of the TA gene into a site or locus of the host cell genome that comprises complementary sequence. Integration can be via a recombination event. The regulatory sequence can be any regulatory sequence known in the art or provided herein such as, for example, a promoter, start, stop, signal, secretion and/or termination sequence used by the genetic machinery of the host cell.

pyc Library

In certain embodiments is provided herein a library of pyc genes for use in the methods provided herein. The library of pyc genes can comprise one or more pyc genes. Each pyc gene in the library can be a native form of the pyc gene, respectively or a mutated form. The mutated form can comprise one or more mutations selected from an insertion, deletion, single nucleotide polymorphism (SNP), or translocation. Each pyc gene in the library can be a pyc gene, respectively. The pyc gene can be any pyc gene, respectively from a prokaryotic cell (i.e., Bacteria and/or Archaea) known in the art. The pyc gene can be any pyc gene, respectively from a eukaryotic cell (e.g., fungal) known in the art. A pyc can be considered any protein comprising pyruvate carboxylase activity. For example, a pyc for use herein can be any enzyme that converts pyruvate to oxaloacetate.

The host cell can be any host cell provided herein. In some embodiments, the library of pyc genes comprises pyc genes, respectively from any strain/species/sub-species of *Mycobacterium* (e.g., *Mycobacterium smegmatis*), *Streptomyces* (e.g., *Streptomyces coelicolor*), *Zymomonas* (e.g., *Zymomonas mobilis*), *Synechocystis* (e.g., *Synechocystis* sp. PCC6803), *Bifidobacterium* (e.g., *Bifidobacterium longum*), *Bacillus* (e.g., *Bacillus subtilis*), *Corynebacterium* (e.g., *Corynebacterium glutamicum*), *Saccharomyces* (e.g., *S. cerevisiae*) or a combination thereof.

In some embodiments, the pyc enzyme of the present disclosure exhibits at least 100%, 99%, 98%, 97%, 96%, 95%, 94%, 93%, 92%, 91%, 90%, 89%, 88%, 87%, 86%, 85%, 84%, 83%, 82%, 81%, 80%, 79%, 78%, 77%, 76%, or 75% sequence identity with a pyc enzyme, respectively provided herein.

Each pyc gene in the library can be functionally linked or under the control of its native promoter or a mutated form of its native promoter. Each pyc gene in the library can be functionally linked to or controlled by any promoter provided herein. Each pyc gene in a library of pyc genes can be present in a chimeric construct such that the gene can be flanked by one or more regulatory sequences and/or sequence homologous to sequence present in the genome of a host cell. The sequence homologous to sequence present in the host cell can facilitate integration of the pyc gene into a site or locus of the host cell genome that comprises complementary sequence. Integration can be via a recombination event. The regulatory sequence can be any regulatory sequence known in the art or provided herein such as, for example, a promoter, start, stop, signal, secretion and/or termination sequence used by the genetic machinery of the host cell.

Generating Mutated Forms of gapA Gene

As provided herein, a gapA gene for use in the methods provided herein can be a mutated form of the gene from which it is derived. The mutated gene can be mutated in any way known in the art or provided herein.

In some embodiments, the present disclosure teaches mutating cell populations by introducing, deleting, or replacing selected portions of genomic DNA. Thus, in some embodiments, the present disclosure teaches methods for targeting mutations to a specific locus (e.g., gapA). In other embodiments, the present disclosure teaches the use of gene editing technologies such as ZFNs, TALENS, or CRISPR, to selectively edit target DNA regions. Following mutation of the cell populations, the targeted mutations can be isolated from the cells and subsequently used for generating a library of gapA genes.

In some embodiments, the present disclosure teaches mutating selected DNA regions (e.g., gapA gene) outside of the host organism. For example, in some embodiments, the present disclosure teaches mutating native gapA gene.

In some embodiments, the selected regions of DNA are produced in vitro via gene shuffling of natural variants, or shuffling with synthetic oligos, plasmid-plasmid recombination, virus plasmid recombination, or virus-virus recombination. In other embodiments, the genomic regions are produced via error-prone PCR or site-directed mutagenesis.

In some embodiments, generating mutations in selected genetic regions containing a gapA gene is accomplished by "reassembly PCR." Briefly, oligonucleotide primers (oligos) are synthesized for PCR amplification of segments of a nucleic acid sequence of interest (e.g., gapA gene), such that the sequences of the oligonucleotides overlap the junctions of two segments. The overlap region is typically about 10 to 100 nucleotides in length. Each of the segments is amplified with a set of such primers. The PCR products are then "reassembled" according to assembly protocols. In brief, in an assembly protocol, the PCR products are first purified away from the primers, by, for example, gel electrophoresis or size exclusion chromatography. Purified products are mixed together and subjected to about 1-10 cycles of denaturing, reannealing, and extension in the presence of polymerase and deoxynucleoside triphosphates (dNTP's) and appropriate buffer salts in the absence of additional primers ("self-priming"). Subsequent PCR with primers flanking the gene are used to amplify the yield of the fully reassembled and shuffled genes.

In some embodiments of the disclosure, mutated gapA DNA regions, such as those discussed above, are enriched for mutant sequences so that the multiple mutant spectrum, i.e. possible combinations of mutations, is more efficiently sampled. In some embodiments, mutated sequences are identified via a mutS protein affinity matrix (Wagner et al., Nucleic Acids Res. 23(19):3944-3948 (1995); Su et al., Proc. Natl. Acad. Sci. (U.S.A.), 83:5057-5061(1986)) with a preferred step of amplifying the affinity-purified material in vitro prior to an assembly reaction. This amplified material is then put into an assembly or reassembly PCR reaction.

In some embodiments, mutated gapA DNA regions are found in nature.

Generating Mutated forms of Nicotinamide Nucleotide Transhydrogenase Gene

As provided herein, a nicotinamide nucleotide transhydrogenase gene for use in the methods provided herein can be a mutated form of the gene from which it is derived. The mutated gene can be mutated in any way known in the art or provided herein.

In some embodiments, the present disclosure teaches mutating cell populations by introducing, deleting, or replacing selected portions of genomic DNA. Thus, in some embodiments, the present disclosure teaches methods for targeting mutations to a specific locus (e.g., nicotinamide nucleotide transhydrogenase). In other embodiments, the present disclosure teaches the use of gene editing technologies such as ZFNs, TALENS, or CRISPR, to selectively edit target DNA regions. Following mutation of the cell populations, the targeted mutations can be isolated from the cells and subsequently used for generating a library of nicotinamide nucleotide transhydrogenase genes.

In some embodiments, the present disclosure teaches mutating selected DNA regions (e.g., nicotinamide nucleotide transhydrogenase gene) outside of the host organism. For example, in some embodiments, the present disclosure teaches mutating native nicotinamide nucleotide transhydrogenase gene.

In some embodiments, the selected regions of DNA are produced in vitro via gene shuffling of natural variants, or shuffling with synthetic oligos, plasmid-plasmid recombination, virus plasmid recombination, or virus-virus recombination. In other embodiments, the genomic regions are produced via error-prone PCR or site-directed mutagenesis.

In certain embodiments, generating mutations in selected genetic regions containing a nicotinamide nucleotide transhydrogenase gene is accomplished by "reassembly PCR."

In some embodiments, mutated nicotinamide nucleotide transhydrogenase DNA regions, such as those discussed above, are enriched for mutant sequences so that the multiple mutant spectrum, i.e. possible combinations of mutations, is more efficiently sampled. In some embodiments, mutated sequences are identified via a mutS protein affinity matrix with a preferred step of amplifying the affinity-purified material in vitro prior to an assembly reaction. This amplified material is then put into an assembly or reassembly PCR reaction.

In some embodiments, mutated nicotinamide nucleotide transhydrogenase DNA regions are found in nature.

Generating Mutated forms of gdh, asd, dapB, and/or ddh Gene

As provided herein, a gdh, asd, dapB, or ddh gene for use in the methods provided herein can be a mutated form of the gene from which it is derived. The mutated gene can be mutated in any way known in the art or provided herein.

In some embodiments, the present disclosure teaches mutating cell populations by introducing, deleting, or replacing selected portions of genomic DNA. Thus, in some embodiments, the present disclosure teaches methods for targeting mutations to a specific locus (e.g., gdh, asd, dapB, or ddh). In other embodiments, the present disclosure teaches the use of gene editing technologies such as ZFNs, TALENS, or CRISPR, to selectively edit target DNA regions. Following mutation of the cell populations, the targeted mutations can be isolated from the cells and subsequently used for generating a library of nicotinamide nucleotide transhydrogenase genes.

In some embodiments, the present disclosure teaches mutating selected DNA regions (e.g., gdh, asd, dapB, or ddh gene) outside of the host organism. For example, in some embodiments, the present disclosure teaches mutating native gdh, asd, dapB, or ddh gene.

In some embodiments, the selected regions of DNA are produced in vitro via gene shuffling of natural variants, or shuffling with synthetic oligos, plasmid-plasmid recombination, virus plasmid recombination, or virus-virus recombination. In other embodiments, the genomic regions are produced via error-prone PCR or site-directed mutagenesis.

In certain embodiments, generating mutations in selected genetic regions containing a nicotinamide nucleotide transhydrogenase gene is accomplished by "reassembly PCR."

In some embodiments, mutated gdh, asd, dapB, and/or ddh DNA regions, such as those discussed above, are enriched for mutant sequences so that the multiple mutant spectrum, i.e. possible combinations of mutations, is more efficiently sampled. In some embodiments, mutated sequences are identified via a mutS protein affinity matrix with a preferred step of amplifying the affinity-purified material in vitro prior to an assembly reaction. This amplified material is then put into an assembly or reassembly PCR reaction.

In some embodiments, mutated or variant gdh, asd, dapB, and/or ddh DNA regions are found in nature. In certain embodiments, naturally occurring variants of *C. glutamicum* ddh is found in bacteria including, but not limited to, *A. oris, H. archaeon, coprobacillus, M. harundinacea, M. micronuciformis, A. denitrificans, M. luteus, B. faecium*, and *carnobacterium*. In certain embodiments, naturally occurring variants of *C. glutamicum* asd is found in bacteria including, but not limited to, *M. jannaschii, S. usitatus, N. innermongolicus, C. aurantiacus, L. agilis, B. pullorum, B. bacterium, M. hansupus*, and *P. sabinae*. In some embodiments, naturally occurring variants of *C. glutamicum* gdh is found in bacteria including, but not limited to, *C. symbiosum*. In some embodiments, naturally occurring variants of *C. glutamicum* dapB is found in bacteria including, but not limited to, *E. coli*. In certain embodiments, the naturally occurring variants of *C. glutamicum* gdh, asd, dapB, and/or ddh are found by performing a genome-wide homology search in an organism (e.g., a bacterium).

Generating Mutated Forms of TA Gene

As provided herein, a TA gene for use in the methods provided herein can be a mutated form of the gene from which it is derived. The mutated gene can be mutated in any way known in the art or provided herein.

In some embodiments, the present disclosure teaches mutating cell populations by introducing, deleting, or replacing selected portions of genomic DNA. Thus, in some embodiments, the present disclosure teaches methods for targeting mutations to a specific locus (e.g., TA). In other embodiments, the present disclosure teaches the use of gene editing technologies such as ZFNs, TALENS, or CRISPR, to selectively edit target DNA regions. Following mutation of the cell populations, the targeted mutations can be isolated from the cells and subsequently used for generating a library of nicotinamide nucleotide transhydrogenase genes.

In some embodiments, the present disclosure teaches mutating selected DNA regions (e.g., TA gene) outside of the host organism. For example, in some embodiments, the present disclosure teaches mutating native TA gene.

In some embodiments, the selected regions of DNA are produced in vitro via gene shuffling of natural variants, or shuffling with synthetic oligos, plasmid-plasmid recombination, virus plasmid recombination, or virus-virus recombination. In other embodiments, the genomic regions are produced via error-prone PCR or site-directed mutagenesis.

In certain embodiments, generating mutations in selected genetic regions containing a nicotinamide nucleotide transhydrogenase gene is accomplished by "reassembly PCR."

In some embodiments, mutated TA DNA regions, such as those discussed above, are enriched for mutant sequences so that the multiple mutant spectrum, i.e. possible combinations of mutations, is more efficiently sampled. In some embodiments, mutated sequences are identified via a mutS protein affinity matrix with a preferred step of amplifying the affinity-purified material in vitro prior to an assembly reaction. This amplified material is then put into an assembly or reassembly PCR reaction.

In some embodiments, mutated or variant TA DNA regions are found in nature. In certain embodiments, naturally occurring variants of *C. glutamicum* TA is found in bacteria including, but not limited to, *A. oris, H. archaeon, coprobacillus, M. harundinacea, M. micronuciformis, A. denitrificans, M. luteus, B. faecium*, and *carnobacterium*. In certain embodiments, the naturally occurring variants of *C. glutamicum* TA are found by performing a genome-wide homology search in an organism (e.g., a bacterium).

Generating Mutated Forms of Pyc Gene

As provided herein, a pyc gene for use in the methods provided herein can be a mutated form of the gene from which it is derived. The mutated gene can be mutated in any way known in the art or provided herein.

In some embodiments, the present disclosure teaches mutating cell populations by introducing, deleting, or replacing selected portions of genomic DNA. Thus, in some embodiments, the present disclosure teaches methods for targeting mutations to a specific locus (e.g., pyc). In other embodiments, the present disclosure teaches the use of gene editing technologies such as ZFNs, TALENS, or CRISPR, to selectively edit target DNA regions. Following mutation of the cell populations, the targeted mutations can be isolated from the cells and subsequently used for generating a library of nicotinamide nucleotide transhydrogenase genes.

In some embodiments, the present disclosure teaches mutating selected DNA regions (e.g., pyc gene) outside of the host organism. For example, in some embodiments, the present disclosure teaches mutating native pyc gene.

In some embodiments, the selected regions of DNA are produced in vitro via gene shuffling of natural variants, or shuffling with synthetic oligos, plasmid-plasmid recombination, virus plasmid recombination, or virus-virus recombination. In other embodiments, the genomic regions are produced via error-prone PCR or site-directed mutagenesis.

In certain embodiments, generating mutations in selected genetic regions containing a nicotinamide nucleotide transhydrogenase gene is accomplished by "reassembly PCR."

In some embodiments, mutated pyc DNA regions, such as those discussed above, are enriched for mutant sequences so that the multiple mutant spectrum, i.e. possible combinations of mutations, is more efficiently sampled. In some embodiments, mutated sequences are identified via a mutS protein affinity matrix with a preferred step of amplifying the affinity-purified material in vitro prior to an assembly reaction. This amplified material is then put into an assembly or reassembly PCR reaction.

In some embodiments, mutated or variant pyc DNA regions are found in nature. In certain embodiments, naturally occurring variants of *C. glutamicum* pyc is found in bacteria including, but not limited to, *A. oris, H. archaeon, coprobacillus, M. harundinacea, M. micronuciformis, A. denitrificans, M. luteus, B. faecium*, and *carnobacterium*. In certain embodiments, the naturally occurring variants of *C. glutamicum* pyc are found by performing a genome-wide homology search in an organism (e.g., a bacterium).

Generation of Libraries Comprising gapA Genes

In some embodiments, the present disclosure teaches inserting and/or replacing and/or deleting a DNA segment comprising a gapA gene of the host organism. In some aspects, the methods taught herein involve building an oligonucleotide of interest (i.e. a gapA segment), which can be incorporated into the genome of a host organism. In some embodiments, the gapA DNA segments of the present disclosure can be obtained via any method known in the art, including, copying or cutting from a known template, mutation, or DNA synthesis. In some embodiments, the present disclosure is compatible with commercially available gene synthesis products for producing DNA sequences (e.g., GeneArt™, GeneMaker™, GenScript™, Anagen™, Blue Heron™, Entelechon™, GeNOsys, Inc., or Qiagen™)

In some embodiments, the gapA DNA segment is designed to incorporate the glucose gapA DNA segment into a selected DNA region of the host organism (e.g., adding a useful GAPDH activity). In certain embodiments, the selected DNA region is a neutral integration site. In other embodiments, the gapA DNA segment is designed to remove the native gapA gene from the DNA of the host organisms (e.g., removing a native GAPDH activity).

In some embodiments, the gapA gene used in the inventive methods can be synthesized in stages as oligonucleotides using any of the methods of enzymatic or chemical synthesis known in the art. The oligonucleotides may be synthesized on solid supports such as controlled pore glass (CPG), polystyrene beads, or membranes composed of thermoplastic polymers that may contain CPG. Oligonucleotides can also be synthesized on arrays, on a parallel microscale using microfluidics (Tian et al., Mol. BioSyst., 5, 714-722 (2009)), or known technologies that offer combinations of both (see Jacobsen et al., U.S. Pat. App. No. 2011/0172127).

Synthesis on arrays or through microfluidics offers an advantage over conventional solid support synthesis by reducing costs through lower reagent use. The scale required for gene synthesis is low, so the scale of oligonucleotide product synthesized from arrays or through microfluidics is acceptable. However, the synthesized oligonucleotides are of lesser quality than when using solid support synthesis (See Tian infra; see also Staehler et al., U.S. Pat. App. No. 2010/0216648).

A great number of advances have been achieved in the traditional four-step phosphoramidite chemistry since it was first described in the 1980's (see for example, Sierzchala, et al. *J. Am. Chem. Soc.*, 125, 13427-13441 (2003) using peroxy anion deprotection; Hayakawa et al., U.S. Pat. No. 6,040,439 for alternative protecting groups; Azhayev et al, *Tetrahedron* 57, 4977-4986 (2001) for universal supports; Kozlov et al., *Nucleosides, Nucleotides, and Nucleic Acids*, 24 (5-7), 1037-1041 (2005) for improved synthesis of longer oligonucleotides through the use of large-pore CPG; and Damha et al., *NAR,* 18, 3813-3821 (1990) for improved derivatization).

Regardless of the type of synthesis, the resulting oligonucleotides may then form the smaller building blocks for longer polynucleotides (i.e., gapA genes). In some embodiments, smaller oligonucleotides can be joined together using protocols known in the art, such as polymerase chain assembly (PCA), ligase chain reaction (LCR), and thermodynamically balanced inside-out synthesis (TBIO) (see Czar et al. Trends in Biotechnology, 27, 63-71 (2009)). In PCA, oligonucleotides spanning the entire length of the desired longer product are annealed and extended in multiple cycles (typically about 55 cycles) to eventually achieve full-length product. LCR uses ligase enzyme to join two oligonucleotides that are both annealed to a third oligonucleotide. TBIO synthesis starts at the center of the desired product and is progressively extended in both directions by using overlapping oligonucleotides that are homologous to the forward strand at the 5' end of the gene and against the reverse strand at the 3' end of the gene.

Another method of synthesizing a larger double stranded DNA fragment is to combine smaller oligonucleotides through top-strand PCR (TSP). In this method, a plurality of oligonucleotides spans the entire length of a desired product and contain overlapping regions to the adjacent oligonucleotide(s). Amplification can be performed with universal forward and reverse primers, and through multiple cycles of amplification a full-length double stranded DNA product is formed. This product can then undergo optional error correction and further amplification that results in the desired double stranded DNA fragment end product.

In one method of TSP, the set of smaller oligonucleotides that will be combined to form the full-length desired product are between 40-200 bases long and overlap each other by at least about 15-20 bases. For practical purposes, the overlap region should be at a minimum long enough to ensure specific annealing of oligonucleotides and have a high enough melting temperature ($T_m$) to anneal at the reaction temperature employed. The overlap can extend to the point where a given oligonucleotide is completely overlapped by adjacent oligonucleotides. The amount of overlap does not seem to have any effect on the quality of the final product. The first and last oligonucleotide building block in the assembly should contain binding sites for forward and reverse amplification primers. In one embodiment, the terminal end sequence of the first and last oligonucleotide contain the same sequence of complementarity to allow for the use of universal primers.

Generation of Libraries Comprising Nicotinamide Nucleotide Transhydrogenase Genes In some embodiments, the present disclosure teaches inserting and/or replacing and/or deleting a DNA segment comprising a nicotinamide nucleotide transhydrogenase gene of the host organism. In some aspects, the methods taught herein involve building an oligonucleotide of interest (i.e. a nicotinamide nucleotide transhydrogenase segment), which can be incorporated into the genome of a host organism. In some embodiments, the nicotinamide nucleotide transhydrogenase DNA segments of the present disclosure can be obtained via any method known in the art, including, copying or cutting from a known template, mutation, or DNA synthesis. In some embodiments, the present disclosure is compatible with commercially available gene synthesis products for producing DNA sequences (e.g., GeneArt™, GeneMaker™, GenScript™ Anagen™, Blue Heron™, Entelechon™, GeNOsys, Inc., or Qiagen™)

In some embodiments, the nicotinamide nucleotide transhydrogenase DNA segment is designed to incorporate the nicotinamide nucleotide transhydrogenase DNA segment into a selected DNA region of the host organism (e.g., adding a useful transhydrogenase activity). In certain embodiments, the selected DNA region is a neutral integration site. In other embodiments, the nicotinamide nucleotide transhydrogenase DNA segment is designed to remove the native nicotinamide nucleotide transhydrogenase gene from the DNA of the host organisms (e.g., removing a native transhydrogenase activity).

In some embodiments, the nicotinamide nucleotide transhydrogenase gene used in the inventive methods can be synthesized in stages as oligonucleotides using any of the methods of enzymatic or chemical synthesis known in the art. The oligonucleotides may be synthesized on solid supports such as controlled pore glass (CPG), polystyrene beads, or membranes composed of thermoplastic polymers that may contain CPG. Oligonucleotides can also be synthesized on arrays, on a parallel microscale using microfluidics, or known technologies that offer combinations of both.

Synthesis on arrays or through microfluidics offers an advantage over conventional solid support synthesis by reducing costs through lower reagent use. The scale required for gene synthesis is low, so the scale of oligonucleotide product synthesized from arrays or through microfluidics is acceptable. However, the synthesized oligonucleotides are of lesser quality than when using solid support synthesis.

A great number of advances have been achieved in the traditional four-step phosphoramidite chemistry since it was first described in the 1980's (see for example, Sierzchala, et al. *J. Am. Chem. Soc.,* 125, 13427-13441 (2003) using peroxy anion deprotection; Hayakawa et al., U.S. Pat. No. 6,040,439 for alternative protecting groups; Azhayev et al, *Tetrahedron* 57, 4977-4986 (2001) for universal supports; Kozlov et al., Nucleosides, *Nucleotides, and Nucleic Acids,* 24 (5-7), 1037-1041 (2005) for improved synthesis of longer oligonucleotides through the use of large-pore CPG; and Damha et al., *NAR,* 18, 3813-3821 (1990) for improved derivatization).

Regardless of the type of synthesis, the resulting oligonucleotides may then form the smaller building blocks for longer polynucleotides (i.e., nicotinamide nucleotide transhydrogenase genes). In some embodiments, smaller oligonucleotides can be joined together using protocols known in the art, such as polymerase chain assembly (PCA), ligase chain reaction (LCR), and thermodynamically balanced inside-out synthesis (TBIO).

Another method of synthesizing a larger double stranded DNA fragment is to combine smaller oligonucleotides through top-strand PCR (TSP). In one method of TSP, the set of smaller oligonucleotides that will be combined to form the full-length desired product are between 40-200 bases long and overlap each other by at least about 15-20 bases. For practical purposes, the overlap region should be at a minimum long enough to ensure specific annealing of oligonucleotides and have a high enough melting temperature ($T_m$) to anneal at the reaction temperature employed. The overlap can extend to the point where a given oligonucleotide is completely overlapped by adjacent oligonucleotides. The amount of overlap does not seem to have any effect on the quality of the final product. The first and last oligonucleotide building block in the assembly should contain binding sites for forward and reverse amplification primers. In one embodiment, the terminal end sequence of the first and last oligonucleotide contain the same sequence of complementarity to allow for the use of universal primers.

Modulating Pyruvate Carboxylase

Pyruvate carboxylase can be expressed in the host cell from an expression vector containing a nucleic acid fragment comprising the nucleotide sequence encoding the pyruvate carboxylase. Alternatively, the nucleic acid fragment comprising the nucleotide sequence encoding pyruvate carboxylase can be integrated into the host's chromosome. Nucleic acid sequences, whether heterologous or endogenous with respect to the host cell, can be introduced into a bacterial chromosome using, for example, homologous recombination. First, the gene of interest and a gene encoding a drug resistance marker are inserted into a plasmid that contains piece of DNA that is homologous to the region of the chromosome within which the gene of interest is to be inserted. Next this recombinagenic DNA is introduced into the bacteria, and clones are selected in which the DNA fragment containing the gene of interest and drug resistant marker has recombined into the chromosome at the desired location. The gene and drug resistant marker can be introduced into the bacteria via transformation either as a linearized piece of DNA that has been prepared from any cloning vector, or as part of a specialized recombinant suicide vector that cannot replicate in the bacterial host. In the case of linearized DNA, a recD⁻ host can be used to increase the frequency at which the desired recombinants are obtained. Clones are then verified using PCR and primers that amplify DNA across the region of insertion. PCR products from non-recombinant clones will be smaller in size and only contain the region of the chromosome where the insertion event was to take place, while PCR products from the recombinant clones will be larger in size and contain the region of the chromosome plus the inserted gene and drug resistance.

In a preferred embodiment, the host cell, preferably *E. coli, C. glutamicum, B. flavum* or *B. lactofermentum*, is transformed with a nucleic acid fragment comprising a pyruvate carboxylase gene, preferably a gene that is isolated from *R. etli* or *P. fluorescens*, more preferably the pyc gene from *R. etli*, such that the gene is transcribed and expressed in the host cell to cause increased production of oxaloacetate and, consequently, increased production of the downstream metabolite of interest, relative to a comparable wild-type cell.

The metabolically engineered cell of the disclosure overexpresses pyruvate carboxylase. Stated in another way, the metabolically engineered cell expresses pyruvate carboxylase at a level higher than the level of pyruvate carboxylase expressed in a comparable wild-type cell. This comparison can be made in any number of ways by one of skill in the art and is done under comparable growth conditions. For example, pyruvate carboxylase activity can be quantified and compared using the method of Payne and Morris (*J. Gen. Microbiol.*, 59, 97-101 (1969)). The metabolically engineered cell that overexpresses pyruvate carboxylase will yield a greater activity than a wild-type cell in this assay. In addition, or alternatively, the amount of pyruvate carboxylase can be quantified and compared by preparing protein extracts from the cells, subjecting them to SDS-PAGE, transferring them to a Western blot, then detecting the biotinylated pyruvate carboxylase protein using detection kits which are commercial available from, for example, Pierce Chemical Company (Rockford, Ill.), Sigma Chemical Company (St. Louis, Mo.) or Boehringer Mannheim (Indianapolis, Ind.) for visualizing biotinylated proteins on Western blots. In some suitable host cells, pyruvate carboxylase expression in the non-engineered, wild-type cell may be below detectable levels.

Generation of Libraries Comprising Gdh, Asd, dapB, and/or Ddh Genes

In some embodiments, the present disclosure teaches inserting and/or replacing and/or deleting a DNA segment comprising a gdh, asd, dapB, and/or ddh gene of the host organism. In some aspects, the methods taught herein involve building an oligonucleotide of interest (i.e. a gdh, asd, dapB, and/or ddh segment), which can be incorporated into the genome of a host organism. In some embodiments, the gdh, asd, dapB, and/or ddh DNA segments of the present disclosure can be obtained via any method known in the art, including, copying or cutting from a known template, mutation, or DNA synthesis. In some embodiments, the present disclosure is compatible with commercially available gene synthesis products for producing DNA sequences (e.g., GeneArt™, GeneMaker™, GenScript™, Anagen™, Blue Heron™, Entelechon™ GeNOsys, Inc., or Qiagen™)

In some embodiments, the gdh, asd, dapB, and/or ddh DNA segment is designed to incorporate one or more glucose gdh, asd, dapB, and/or ddh DNA segments into a selected DNA region of the host organism (e.g., adding one or more useful glutamate dehydrogenase, aspartate semialdehyde dehydrogenase, dihydropicolinate reductase, and/or meso-diaminopimelate dehydrogenase activity). In certain embodiments, the selected DNA region is a neutral integration site. In other embodiments, the gdh, asd, dapB, and/or ddh DNA segment is designed to remove one or more native gdh, asd, dapB, and/or ddh gene from the DNA of the host organisms (e.g., removing one or more native glutamate dehydrogenase, aspartate semialdehyde dehydrogenase, dihydropicolinate reductase, and/or meso-diaminopimelate dehydrogenase activity).

In some embodiments, the gdh, asd, dapB, and/or ddh gene used in the inventive methods can be synthesized in stages as oligonucleotides using any of the methods of enzymatic or chemical synthesis known in the art. The oligonucleotides may be synthesized on solid supports such as controlled pore glass (CPG), polystyrene beads, or membranes composed of thermoplastic polymers that may contain CPG. Oligonucleotides can also be synthesized on arrays, on a parallel microscale using microfluidics, or known technologies that offer combinations of both.

Synthesis on arrays or through microfluidics offers an advantage over conventional solid support synthesis by reducing costs through lower reagent use. The scale required for gene synthesis is low, so the scale of oligonucleotide product synthesized from arrays or through microfluidics is acceptable. However, the synthesized oligonucleotides are of lesser quality than when using solid support synthesis.

A great number of advances have been achieved in the traditional four-step phosphoramidite chemistry since it was first described in the 1980's (see for example, Sierzchala, et al. *J. Am. Chem. Soc.*, 125, 13427-13441 (2003) using peroxy anion deprotection; Hayakawa et al., U.S. Pat. No. 6,040,439 for alternative protecting groups; Azhayev et al, *Tetrahedron* 57, 4977-4986 (2001) for universal supports; Kozlov et al., *Nucleosides, Nucleotides, and Nucleic Acids*, 24 (5-7), 1037-1041 (2005) for improved synthesis of longer oligonucleotides through the use of large-pore CPG; and Damha et al., *NAR*, 18, 3813-3821 (1990) for improved derivatization).

Regardless of the type of synthesis, the resulting oligonucleotides may then form the smaller building blocks for longer polynucleotides (i.e., gdh, asd, dapB, and/or ddh genes). In some embodiments, smaller oligonucleotides can be joined together using protocols known in the art, such as polymerase chain assembly (PCA), ligase chain reaction (LCR), and thermodynamically balanced inside-out synthesis (TBIO).

Another method of synthesizing a larger double stranded DNA fragment is to combine smaller oligonucleotides through top-strand PCR (TSP). In one method of TSP, the set of smaller oligonucleotides that will be combined to form the full-length desired product are between 40-200 bases long and overlap each other by at least about 15-20 bases. For practical purposes, the overlap region should be at a minimum long enough to ensure specific annealing of oligonucleotides and have a high enough melting temperature ($T_m$) to anneal at the reaction temperature employed. The overlap can extend to the point where a given oligonucleotide is completely overlapped by adjacent oligonucleotides. The amount of overlap does not seem to have any effect on the quality of the final product. The first and last oligonucleotide building block in the assembly should contain binding sites for forward and reverse amplification primers. In one embodiment, the terminal end sequence of the first and last oligonucleotide contain the same sequence of complementarity to allow for the use of universal primers.

Generation of Libraries Comprising Threonine Aldolase (TA) Genes

In some embodiments, the present disclosure teaches inserting and/or replacing and/or deleting a DNA segment comprising a TA gene of the host organism. In some aspects, the methods taught herein involve building an oligonucleotide of interest (i.e. a TA segment), which can be incorporated into the genome of a host organism. In some embodiments, the TA DNA segments of the present disclosure can be obtained via any method known in the art, including, copying or cutting from a known template, mutation, or DNA synthesis. In some embodiments, the present disclosure is compatible with commercially available gene synthesis products for producing DNA sequences (e.g., GeneArt™, GeneMaker™, GenScript™, Anagen™, Blue Heron™, Entelechon™, GeNOsys, Inc., or Qiagen™)

In some embodiments, the TA DNA segment is designed to incorporate one or more TA DNA segments into a selected DNA region of the host organism (e.g., adding one or more useful gens having threonine aldolase activity). In certain embodiments, the selected DNA region is a neutral integration site. In other embodiments, the TA DNA segment is designed to remove one or more native TA gene from the DNA of the host organisms (e.g., removing one or more genes having threonine aldolase activity).

In some embodiments, the TA gene used in the inventive methods can be synthesized in stages as oligonucleotides using any of the methods of enzymatic or chemical synthesis known in the art. The oligonucleotides may be synthesized on solid supports such as controlled pore glass (CPG), polystyrene beads, or membranes composed of thermoplastic polymers that may contain CPG. Oligonucleotides can also be synthesized on arrays, on a parallel microscale using microfluidics, or known technologies that offer combinations of both.

Synthesis on arrays or through microfluidics offers an advantage over conventional solid support synthesis by reducing costs through lower reagent use. The scale required for gene synthesis is low, so the scale of oligonucleotide product synthesized from arrays or through microfluidics is acceptable. However, the synthesized oligonucleotides are of lesser quality than when using solid support synthesis.

A great number of advances have been achieved in the traditional four-step phosphoramidite chemistry since it was first described in the 1980's (see for example, Sierzchala, et al. *J. Am. Chem. Soc.,* 125, 13427-13441 (2003) using peroxy anion deprotection; Hayakawa et al., U.S. Pat. No. 6,040,439 for alternative protecting groups; Azhayev et al, *Tetrahedron* 57, 4977-4986 (2001) for universal supports; Kozlov et al., *Nucleosides, Nucleotides, and Nucleic Acids,* 24 (5-7), 1037-1041 (2005) for improved synthesis of longer oligonucleotides through the use of large-pore CPG; and Damha et al., *NAR,* 18, 3813-3821 (1990) for improved derivatization).

Regardless of the type of synthesis, the resulting oligonucleotides may then form the smaller building blocks for longer polynucleotides (i.e., TA genes). In some embodiments, smaller oligonucleotides can be joined together using protocols known in the art, such as polymerase chain assembly (PCA), ligase chain reaction (LCR), and thermodynamically balanced inside-out synthesis (TBIO).

Another method of synthesizing a larger double stranded DNA fragment is to combine smaller oligonucleotides through top-strand PCR (TSP). In one method of TSP, the set of smaller oligonucleotides that will be combined to form the full-length desired product are between 40-200 bases long and overlap each other by at least about 15-20 bases. For practical purposes, the overlap region should be at a minimum long enough to ensure specific annealing of oligonucleotides and have a high enough melting temperature ($T_m$) to anneal at the reaction temperature employed. The overlap can extend to the point where a given oligonucleotide is completely overlapped by adjacent oligonucleotides. The amount of overlap does not seem to have any effect on the quality of the final product. The first and last oligonucleotide building block in the assembly should contain binding sites for forward and reverse amplification primers. In one embodiment, the terminal end sequence of the first and last oligonucleotide contain the same sequence of complementarity to allow for the use of universal primers.

Generation of Libraries Comprising Pyc Genes

In some embodiments, the present disclosure teaches inserting and/or replacing and/or deleting a DNA segment comprising a pyc gene of the host organism. In some aspects, the methods taught herein involve building an oligonucleotide of interest (i.e. a pyc segment), which can be incorporated into the genome of a host organism. In some embodiments, the pyc DNA segments of the present disclosure can be obtained via any method known in the art, including, copying or cutting from a known template, mutation, or DNA synthesis. In some embodiments, the present disclosure is compatible with commercially available gene synthesis products for producing DNA sequences (e.g., GeneArt™, GeneMaker™, GenScript™, Anagen™, Blue Heron™ Entelechon™, GeNOsys, Inc., or Qiagen™)

In some embodiments, the pyc DNA segment is designed to incorporate one or more glucose pyc DNA segments into a selected DNA region of the host organism (e.g., adding one or more useful genes having pyruvate carboxylase activity). In certain embodiments, the selected DNA region is a neutral integration site. In other embodiments, the pyc DNA segment is designed to remove one or more native pyc gene from the DNA of the host organisms (e.g., removing one or more native genes having pyruvate carboxylase activity).

In some embodiments, the pyc gene used in the inventive methods can be synthesized in stages as oligonucleotides using any of the methods of enzymatic or chemical synthesis known in the art. The oligonucleotides may be synthesized on solid supports such as controlled pore glass (CPG), polystyrene beads, or membranes composed of thermoplastic polymers that may contain CPG. Oligonucleotides can also be synthesized on arrays, on a parallel microscale using microfluidics, or known technologies that offer combinations of both.

Synthesis on arrays or through microfluidics offers an advantage over conventional solid support synthesis by reducing costs through lower reagent use. The scale required for gene synthesis is low, so the scale of oligonucleotide product synthesized from arrays or through microfluidics is acceptable. However, the synthesized oligonucleotides are of lesser quality than when using solid support synthesis.

A great number of advances have been achieved in the traditional four-step phosphoramidite chemistry since it was first described in the 1980's (see for example, Sierzchala, et al. *J. Am. Chem. Soc.*, 125, 13427-13441 (2003) using peroxy anion deprotection; Hayakawa et al., U.S. Pat. No. 6,040,439 for alternative protecting groups; Azhayev et al, *Tetrahedron* 57, 4977-4986 (2001) for universal supports; Kozlov et al., *Nucleosides, Nucleotides, and Nucleic Acids*, 24 (5-7), 1037-1041 (2005) for improved synthesis of longer oligonucleotides through the use of large-pore CPG; and Damha et al., *NAR,* 18, 3813-3821 (1990) for improved derivatization).

Regardless of the type of synthesis, the resulting oligonucleotides may then form the smaller building blocks for longer polynucleotides (i.e., pyc genes). In some embodiments, smaller oligonucleotides can be joined together using protocols known in the art, such as polymerase chain assembly (PCA), ligase chain reaction (LCR), and thermodynamically balanced inside-out synthesis (TBIO).

Another method of synthesizing a larger double stranded DNA fragment is to combine smaller oligonucleotides through top-strand PCR (TSP). In one method of TSP, the set of smaller oligonucleotides that will be combined to form the full-length desired product are between 40-200 bases long and overlap each other by at least about 15-20 bases. For practical purposes, the overlap region should be at a minimum long enough to ensure specific annealing of oligonucleotides and have a high enough melting temperature ($T_m$) to anneal at the reaction temperature employed. The overlap can extend to the point where a given oligonucleotide is completely overlapped by adjacent oligonucleotides. The amount of overlap does not seem to have any effect on the quality of the final product. The first and last oligonucleotide building block in the assembly should contain binding sites for forward and reverse amplification primers. In one embodiment, the terminal end sequence of the first and last oligonucleotide contain the same sequence of complementarity to allow for the use of universal primers.

Assembling/Cloning Plasmids

In some embodiments, the present disclosure teaches methods for constructing vectors capable of inserting desired gapA gene, and/or nicotinamide nucleotide transhydrogenase, and/or gdh, asd, dapB, and/or ddh gene, and/or TA gene, and/or pyc gene DNA sections into the genome of host organisms. In some embodiments, the present disclosure teaches methods of cloning vectors comprising the insert DNA (e.g., gapA gene, and/or nicotinamide nucleotide transhydrogenase, and/or gdh, asd, dapB, and/or ddh gene, and/or TA gene, and/or pyc gene), homology arms, and at least one selection marker. (see FIG. 6).

In some embodiments, the present disclosure is compatible with any vector suited for transformation into the host organism. In some embodiments, the present disclosure teaches use of shuttle vectors compatible with a host cell. In one embodiment, a shuttle vector for use in the methods provided herein is a shuttle vector compatible with an *E. coli* and/or *Corynebacterium* host cell. Shuttle vectors for use in the methods provided herein can comprise markers for selection and/or counter-selection as described herein. The markers can be any markers known in the art and/or provided herein. The shuttle vectors can further comprise any regulatory sequence(s) and/or sequences useful in the assembly of said shuttle vectors as known in the art. The shuttle vectors can further comprise any origins of replication that may be needed for propagation in a host cell as provided herein such as, for example, *E. coli* or *C. glutamicum*. The regulatory sequence can be any regulatory sequence known in the art or provided herein such as, for example, a promoter, start, stop, signal, secretion and/or termination sequence used by the genetic machinery of the host cell. In certain instances, the target DNA can be inserted into vectors, constructs or plasmids obtainable from any repository or catalogue product, such as a commercial vector (see e.g., DNA2.0 custom or GATEWAY® vectors).

In some embodiments, the assembly/cloning methods of the present disclosure may employ at least one of the following assembly strategies: i) type II conventional cloning, ii) type II S-mediated or "Golden Gate" cloning (see, e.g., Engler, C., R. Kandzia, and S. Marillonnet. 2008 "A one pot, one step, precision cloning method with high throughput capability". PLos One 3:e3647; Kotera, I., and T. Nagai. 2008 "A high-throughput and single-tube recombination of crude PCR products using a DNA polymerase inhibitor and type IIS restriction enzyme." J Biotechnol 137:1-7; Weber, E., R. Gruetzner, S. Werner, C. Engler, and S. Marillonnet. 2011 Assembly of Designer TAL Effectors by Golden Gate Cloning. PloS One 6:e19722), iii) GATEWAY® recombination, iv) TOPO® cloning, exonuclease-mediated assembly (Aslanidis and de Jong 1990. "Ligation-independent cloning of PCR products (LIC-PCR)." Nucleic Acids Research, Vol. 18, No. 20 6069), v) homologous recombination, vi) non-homologous end joining, or a combination thereof. Modular type IIS based assembly strategies are disclosed in PCT Publication WO 2011/154147, the disclosure of which is included herein by reference.

In some embodiments, the present disclosure teaches cloning vectors with at least one selection marker. Various selection marker genes are known in the art often encoding antibiotic resistance function for selection in prokaryotic (e.g., against ampicillin, kanamycin, tetracycline, chloramphenycol, zeocin, spectinomycin/streptomycin) or eukaryotic cells (e.g. geneticin, neomycin, hygromycin, puromycin, blasticidin, zeocin) under selective pressure. Other marker systems allow for screening and identification of wanted or unwanted cells such as the well-known blue/white screening system used in bacteria to select positive clones in the presence of X-gal or fluorescent reporters such as green or red fluorescent proteins expressed in successfully transduced host cells. Another class of selection markers most of which are only functional in prokaryotic systems relates to counter selectable marker genes often also referred to as "death genes" which express toxic gene products that kill producer cells. Examples of such genes include sacB, rpsL (strA), tetAR, pheS, thyA, gata-1, or ccdB, the function of which is described in (Reyrat et al. 1998 "Counterselectable Markers: Untapped Tools for Bacterial Genetics and Pathogenesis." Infect Immun. 66(9): 4011-4017).

In some embodiments, the vector into which the target DNA segment is cloned into comprises a promoter polynucleotide. The promoter polynucleotide can be used for over-expressing or under-expressing a gapA, and/or nicotinamide nucleotide transhydrogenase, and/or gdh, asd, dapB, and/or ddh, and/or TA, and/or pyc in a host microorganism.

In some embodiments, each generated strain comprising a heterologous gapA gene, and/or nicotinamide nucleotide transhydrogenase gene, and/or one or more of gdh, asd, dapB, and ddh genes, and/or TA gene, and/or pyc gene is cultured and analyzed under one or more criteria of the present disclosure (e.g., productivity of a biomolecule or product of interest). Data from each of the analyzed host strains is associated/correlated with a particular gapA gene, or nicotinamide nucleotide transhydrogenase gene, or gdh, asd, dapB, and/or ddh gene, and/or TA gene, and/or pyc gene or gapA/nicotinamide nucleotide transhydrogenase/gdh, asd, dapB, and/or ddh gene/TA/pyc combinations, and is recorded for future use. Thus, the present disclosure enables the creation of large and highly annotated genetic diversity libraries/depositories that identify the effect of a gapA gene, or nicotinamide nucleotide transhydrogenase gene, or gdh, asd, dapB, and/or ddh gene, and/or TA gene, and/or pyc gene or gapA/nicotinamide nucleotide transhydrogenase/gdh, asd, dapB, and/or ddh/TA/pyc gene combinations on any number of genetic or phenotypic traits of interest.

In some embodiments, the strains within a diversity pool are determined with reference to a "reference strain." In some embodiments, the reference strain is a wild-type strain. In other embodiments, the reference strain is an original industrial strain prior to being subjected to any genomic engineering. The reference strain can be defined by the practitioner and does not have to be an original wild-type strain or original industrial strain. The base strain is merely representative of what will be considered the "base," "reference" or original genetic background, by which subsequent strains that were derived, or were developed from said reference strain, are to be compared.

A concept to keep in mind is that of differences between: parent strain and reference strain. The parent strain is the background that was used for a current round of genomic engineering. The reference strain is a control strain run in every plate to facilitate comparisons, especially between plates, and is typically the "base strain" as referenced above. But since the base strain (e.g., the wild-type or industrial strain being used to benchmark overall performance) is not necessarily a "base" in the sense of being a mutagenesis target in a given round of strain improvement, a more descriptive term is "reference strain."

In summary, a base/reference strain is used to benchmark the performance of built strains, generally, while the parent strain is used to benchmark the performance of a specific genetic change in the relevant genetic background.

In some embodiments, the present disclosure teaches the use of vectors for cloning the gapA gene, and/or nicotinamide nucleotide transhydrogenase, and/or gdh, asd, dapB, and/or ddh genes, and/or TA gene, and/or pyc gene with start and/or stop codon variants such that the cloned gene utilizes the start and/or stop codon variant. For example, typical stop codons for S. cerevisiae and mammals are UAA and UGA, respectively. The typical stop codon for monocotyledonous plants is UGA, whereas insects and E. coli commonly use UAA as the stop codon (Dalphin et al. (1996) Nucl. Acids Res. 24: 216-218).

Codon Optimization

In one embodiment, the methods of the provided disclosure comprise codon optimizing one or more genes expressed by the host organism. Methods for optimizing codons to improve expression in various hosts are known in the art and are described in the literature (see U.S. Pat. App. Pub. No. 2007/0292918, incorporated herein by reference in its entirety). Optimized coding sequences containing codons preferred by a particular prokaryotic or eukaryotic host (see also, Murray et al. (1989) Nucl. Acids Res. 17:477-508) can be prepared, for example, to increase the rate of translation or to produce recombinant RNA transcripts having desirable properties, such as a longer half-life, as compared with transcripts produced from a non-optimized sequence.

In some embodiments, a gapA/nicotinamide nucleotide transhydrogenase/gdh, asd, dapB, and/or ddh gene/TA gene/ pyc gene or polynucleotide provided herein comprises a molecule codon optimized for translation in a host cell provided herein, such as, for example, E. coli and/or C. glutamicum. The gene or polynucleotide can be an isolated, synthetic or recombinant nucleic acid. The codon optimized gapA/nicotinamide nucleotide transhydrogenase/gdh, asd, dapB, and/or ddh/TA/pyc gene or polynucleotide can be selected from SEQ ID NO: 1-50, 67-74, 79-231, and 232. The codon optimized gapA/nicotinamide nucleotide transhydrogenase/gdh, asd, dapB, and/or ddh/TA gene/pyc gene or polynucleotide provided herein can be generated using a method known in the art for generating codon optimized polynucleotides such as, for example, GenScript's OptimumGene™ gene design system or DNA2.0 GeneGPS® Expression Optimization technology.

Protein expression is governed by a host of factors including those that affect transcription, mRNA processing, and stability and initiation of translation. Optimization can thus address any of a number of sequence features of any particular gene. As a specific example, a rare codon induced translational pause can result in reduced protein expression. A rare codon induced translational pause includes the presence of codons in the polynucleotide of interest that are rarely used in the host organism may have a negative effect on protein translation due to their scarcity in the available tRNA pool.

Alternate translational initiation also can result in reduced heterologous protein expression. Alternate translational initiation can include a synthetic polynucleotide sequence inadvertently containing motifs capable of functioning as a ribosome binding site (RBS). These sites can result in initiating translation of a truncated protein from a gene-internal site. One method of reducing the possibility of producing a truncated protein, which can be difficult to remove during purification, includes eliminating putative internal RBS sequences from an optimized polynucleotide sequence.

Repeat-induced polymerase slippage can result in reduced heterologous protein expression. Repeat-induced polymerase slippage involves nucleotide sequence repeats that have been shown to cause slippage or stuttering of DNA polymerase which can result in frameshift mutations. Such repeats can also cause slippage of RNA polymerase. In an organism with a high G+C content bias, there can be a higher degree of repeats composed of G or C nucleotide repeats. Therefore, one method of reducing the possibility of inducing RNA polymerase slippage, includes altering extended repeats of G or C nucleotides.

Interfering secondary structures also can result in reduced heterologous protein expression. Secondary structures can sequester the RBS sequence or initiation codon and have been correlated to a reduction in protein expression. Stem-loop structures can also be involved in transcriptional pausing and attenuation. An optimized polynucleotide sequence can contain minimal secondary structures in the RBS and gene coding regions of the nucleotide sequence to allow for improved transcription and translation.

For example, the optimization process can begin by identifying the desired amino acid sequence to be expressed by the host. From the amino acid sequence a candidate polynucleotide or DNA sequence can be designed. During the design of the synthetic DNA sequence, the frequency of codon usage can be compared to the codon usage of the host expression organism and rare host codons can be removed from the synthetic sequence. Additionally, the synthetic candidate DNA sequence can be modified in order to remove undesirable enzyme restriction sites and add or remove any desired signal sequences, linkers or untranslated regions. The synthetic DNA sequence can be analyzed for the presence of secondary structure that may interfere with the translation process, such as G/C repeats and stem-loop structures.

Transformation of Host Cells

In some embodiments, the vectors of the present disclosure may be introduced into the host cells using any of a variety of techniques, including transformation, transfection, transduction, viral infection, gene guns, or Ti-mediated gene transfer. Particular methods include calcium phosphate transfection, DEAE-Dextran mediated transfection, lipofection, or electroporation (Davis, L., Dibner, M., Battey, I., 1986 "Basic Methods in Molecular Biology"). Other methods of transformation include for example, lithium acetate transformation and electroporation See, e.g., Gietz et al., Nucleic Acids Res. 27:69-74 (1992); Ito et al., J. Bacterol. 153:163-168 (1983); and Becker and Guarente, Methods in Enzymology 194:182-187 (1991). In some embodiments, transformed host cells are referred to as recombinant host strains.

In some embodiments, the present disclosure teaches high throughput transformation of cells using 96-well plate robotics platform and liquid handling machines known in the art.

In some embodiments, the present disclosure teaches screening transformed cells with one or more selection markers. In one such embodiment, cells transformed with a vector comprising a kanamycin resistance marker (KanR) are plated on media containing effective amounts of the kanamycin antibiotic. Colony forming units visible on kanamycin-laced media are presumed to have incorporated the vector cassette into their genome. Insertion of the desired sequences can be confirmed via PCR, restriction enzyme analysis, and/or sequencing of the relevant insertion site.

Looping Out of Selected Sequences

In some embodiments, the present disclosure teaches methods of looping out selected regions of DNA from the host organisms. The looping out method can be as described in Nakashima et al. 2014 "Bacterial Cellular Engineering by Genome Editing and Gene Silencing." Int. J. Mol. Sci. 15(2), 2773-2793. In some embodiments, the present disclosure teaches looping out selection markers from positive transformants. Looping out deletion techniques are known in the art, and are described in (Tear et al. 2014 "Excision of Unstable Artificial Gene-Specific inverted Repeats Mediates Scar-Free Gene Deletions in *Escherichia coli*." Appl. Biochem. Biotech. 175:1858-1867). The looping out methods used in the methods provided herein can be performed using single-crossover homologous recombination or double-crossover homologous recombination. In certain embodiments, looping out of selected regions as described herein can entail using single-crossover homologous recombination as described herein.

Figure 6:
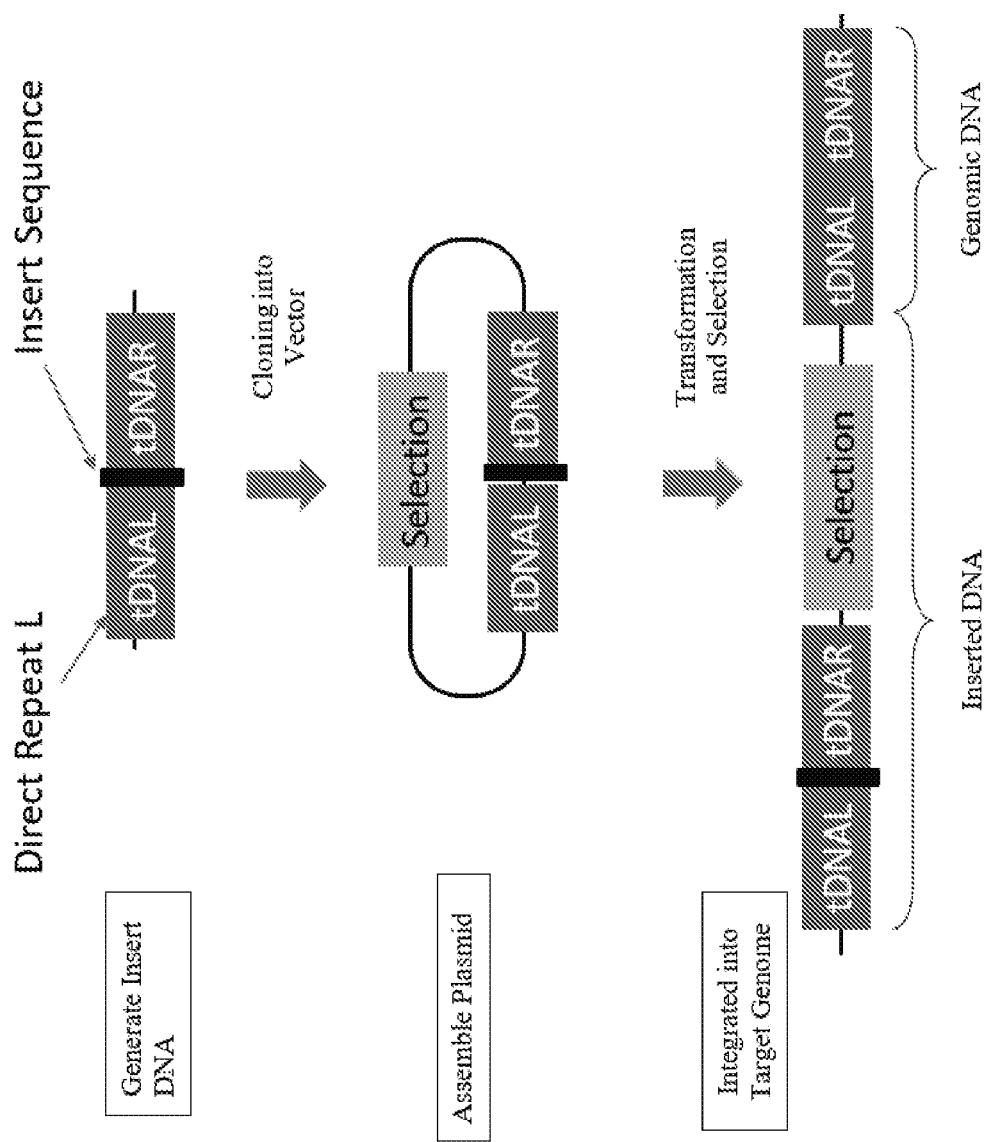
FIG. 6 depicts assembly of transformation plasmids of the present disclosure, and their integration into host organisms.

First, loop out vectors are inserted into selected target regions within the genome of the host organism (e.g., via homologous recombination, CRISPR, or other gene editing technique). In one embodiment, single-crossover homologous recombination is used between a circular plasmid or vector and the host cell genome in order to loop-in the circular plasmid or vector such as depicted in FIG. 6. The inserted vector can be designed with a sequence which is a direct repeat of an existing or introduced nearby host sequence, such that the direct repeats flank the region of DNA slated for looping and deletion. Once inserted, cells containing the loop out plasmid or vector can be counter selected for deletion of the selection region (e.g., see FIG. 7; lack of resistance to the selection gene).

Host Microorganisms

The genomic engineering methods provided herein are exemplified with industrial microbial cell cultures, but can be applicable to any organism where desired traits can be identified in a population of genetic mutants.

Thus, as used herein, the term "microorganism" should be taken broadly. It includes, but is not limited to, the two prokaryotic domains, Bacteria and Archaea, as well as certain eukaryotic fungi and protists. However, in certain aspects, "higher" eukaryotic organisms such as insects, plants, and animals can be utilized in the methods taught herein.

Suitable host cells include, but are not limited to: bacterial cells, algal cells, plant cells, fungal cells, insect cells, and mammalian cells. In one illustrative embodiment, suitable host cells include *E. coli* (e.g., SHuffle™ competent *E. coli* available from New England BioLabs in Ipswich, Mass.).

Other suitable host organisms of the present disclosure include microorganisms of the genus *Corynebacterium*. In some embodiments, preferred *Corynebacterium* strains/species include: *C. efficiens*, with the deposited type strain being DSM44549, *C. glutamicum*, with the deposited type strain being ATCC13032, and *C. ammoniagenes*, with the deposited type strain being ATCC6871. In some embodiments, the preferred host of the present disclosure is *C. glutamicum*. In some embodiments, the present disclosure teaches host cells of *Shigella*, including *Shigella flexneri, Shigella dysenteriae, Shigella boydii*, and *Shigella sonnei*.

Suitable host strains of the genus *Corynebacterium*, in particular of the species *Corynebacterium glutamicum*, are in particular the known wild-type strains: *Corynebacterium glutamicum* ATCC13032, *Corynebacterium acetoglutamicum* ATCC 15806, *Corynebacterium acetoacidophilum* ATCC13870, *Corynebacterium melassecola* ATCC17965, *Corynebacterium thermoaminogenes* FERM BP-1539, *Brevibacterium flavum* ATCC14067, *Brevibacterium lactofermentum* ATCC13869, and *Brevibacterium divaricatum* ATCC14020; and L-amino acid-producing mutants, or strains, prepared therefrom, such as, for example, the L-lysine-producing strains: *Corynebacterium glutamicum* FERM-P 1709, *Brevibacterium flavum* FERM-P 1708, *Brevibacterium lactofermentum* FERM-P 1712, *Corynebacterium glutamicum* FERM-P 6463, *Corynebacterium glutamicum* FERM-P 6464, *Corynebacterium glutamicum* DM58-1, *Corynebacterium glutamicum* DG52-5, *Corynebacterium glutamicum* DSM5714, and *Corynebacterium glutamicum* DSM12866.

The term "*Micrococcus glutamicus*" has also been in use for *C. glutamicum*. Some representatives of the species *C. efficiens* have also been referred to as *C. thermoaminogenes* in the prior art, such as the strain FERM BP-1539, for example.

In some embodiments, the host cell of the present disclosure is a eukaryotic cell. Suitable eukaryotic host cells include, but are not limited to: fungal cells, algal cells, insect cells, animal cells, and plant cells. Suitable fungal host cells include, but are not limited to: *Ascomycota, Basidiomycota, Deuteromycota, Zygomycota, Fungi imperfecti*. Certain preferred fungal host cells include yeast cells and filamentous fungal cells. Suitable filamentous fungi host cells include, for example, any filamentous forms of the subdivision *Eumycotina* and *Oomycota*. (see, e.g., Hawksworth et al., In Ainsworth and Bisby's Dictionary of The Fungi, 8th edition, 1995, CAB International, University Press, Cambridge, UK, which is incorporated herein by reference). Filamentous fungi are characterized by a vegetative mycelium with a cell wall composed of chitin, cellulose and other complex polysaccharides. The filamentous fungi host cells are morphologically distinct from yeast.

In certain illustrative, but non-limiting embodiments, the filamentous fungal host cell may be a cell of a species of: *Achlya, Acremonium, Aspergillus, Aureobasidium, Bjerkandera, Ceriporiopsis, Cephalosporium, Chrysosporium, Cochliobolus, Corynascus, Cryphonectria, Cryptococcus, Coprinus, Coriolus, Diplodia, Endothis, Fusarium, Gibberella, Gliocladium, Humicola, Hypocrea, Myceliophthora* (e.g., *Myceliophthora thermophila*), *Mucor, Neurospora, Penicillium, Podospora, Phlebia, Piromyces, Pyricularia, Rhizomucor, Rhizopus, Schizophyllum, Scytalidium, Sporotrichum, Talaromyces, Thermoascus, Thielavia, Tramates, Tolypocladium, Trichoderma, Verticillium, Volvariella*, or teleomorphs, or anamorphs, and synonyms or taxonomic equivalents thereof.

Suitable yeast host cells include, but are not limited to: *Candida, Hansenula, Saccharomyces, Schizosaccharomyces, Pichia, Kluyveromyces*, and *Yarrowia*. In some embodiments, the yeast cell is *Hansenula polymorpha, Saccharomyces cerevisiae, Saccharomyces carlsbergensis, Saccharomyces diastaticus, Saccharomyces norbensis, Saccharomyces kluyveri, Schizosaccharomyces pombe, Pichia pastoris, Pichia finlandica, Pichia trehalophila, Pichia kodamae, Pichia membranaefaciens, Pichia opuntiae, Pichia thermotolerans, Pichia salictaria, Pichia quercuum, Pichia pijperi, Pichia stipitis, Pichia methanolica, Pichia angusta, Kluyveromyces lactis, Candida albicans*, or *Yarrowia lipolytica*.

In certain embodiments, the host cell is an algal such as, *Chlamydomonas* (e.g., *C. Reinhardtii*) and *Phormidium* (*P.* sp. ATCC29409).

In other embodiments, the host cell is a prokaryotic cell. Suitable prokaryotic cells include gram positive, gram negative, and gram-variable bacterial cells. The host cell may be a species of, but not limited to: *Agrobacterium, Alicyclobacillus, Anabaena, Anacystis, Acinetobacter, Acidothermus, Arthrobacter, Azobacter, Bacillus, Bifidobacterium, Brevibacterium, Butyrivibrio, Buchnera, Campestris, Camplyobacter, Clostridium, Corynebacterium, Chromatium, Coprococcus, Escherichia, Enterococcus, Enterobacter, Erwinia, Fusobacterium, Faecalibacterium, Francisella, Flavobacterium, Geobacillus, Haemophilus, Helicobacter, Klebsiella, Lactobacillus, Lactococcus, Ilyobacter, Micrococcus, Microbacterium, Mesorhizobium, Methylobacterium, Methylobacterium, Mycobacterium, Neisseria, Pantoea, Pseudomonas, Prochlorococcus, Rhodobacter, Rhodopseudomonas, Rhodopseudomonas, Roseburia, Rhodospirillum, Rhodococcus, Scenedesmus, Streptomyces, Streptococcus, Synecoccus, Saccharomonospora, Staphylococcus, Serratia, Salmonella, Shigella, Thermoanaerobacterium, Tropheryma, Tularensis, Temecula, Thermosynechococcus, Thermococcus, Ureaplasma, Xanthomonas, Xylella, Yersinia*, and *Zymomonas*. In some embodiments, the host cell is *Corynebacterium glutamicum*.

In some embodiments, the host strain is a bacterial host strain. In some embodiments, the bacterial host strain is an industrial strain. Numerous bacterial industrial strains are known and suitable in the methods and compositions described herein.

In some embodiments, the bacterial host cell is of the *Agrobacterium* species (e.g., *A. radiobacter, A. rhizogenes, A. rubi*), the *Arthrobacter* species (e.g., *A. aurescens, A. citreus, A. globformis, A. hydrocarboglutamicus, A. mysorens, A. nicotianae, A. paraffineus, A. protophonniae, A. roseoparaffinus, A. sulfureus, A. ureafaciens*), the *Bacillus* species (e.g., *B. thuringiensis, B. anthracis, B. megaterium, B. subtilis, B. lentus, B. circulars, B. pumilus, B. lautus, B. coagulans, B. brevis, B. firmus, B. alkaophius, B. licheniformis, B. clausii, B. stearothermophilus, B. halodurans* and *B. amyloliquefaciens*. In particular embodiments, the host cell will be an industrial *Bacillus* strain including but not limited to *B. subtilis, B. pumilus, B. licheniformis, B. megaterium, B. clausii, B. stearothermophilus* and *B. amyloliquefaciens*. In some embodiments, the host cell will be an industrial *Clostridium* species (e.g., *C. acetobutylicum, C. tetani* E88, *C. lituseburense, C. saccharobutylicum, C. perfringens, C. beijerinckii*). In some embodiments, the host cell will be an industrial *Corynebacterium* species (e.g., *C. glutamicum, C. acetoacidophilum*). In some embodiments, the host cell will be an industrial *Escherichia* species (e.g., *E. coli*). In some embodiments, the host cell will be an industrial *Erwinia* species (e.g., *E. uredovora, E. carotovora, E. ananas, E. herbicola, E. punctata, E. terreus*). In some embodiments, the host cell will be an industrial *Pantoea* species (e.g., *P. citrea, P. agglomerans*). In some embodiments, the host cell will be an industrial *Pseudomonas* species, (e.g., *P. putida, P. aeruginosa, P. mevalonii*). In some embodiments, the host cell will be an industrial *Streptococcus* species (e.g., *S. equisimiles, S. pyogenes, S. uberis*). In some embodiments, the host cell will be an industrial *Streptomyces* species (e.g., *S. ambofaciens, S. achromogenes, S. avermitilis, S. coelicolor, S. aureofaciens, S. aureus, S. fungicidicus, S. griseus, S. lividans*). In some embodiments, the host cell will be an industrial *Zymomonas* species (e.g., *Z. mobilis, Z. lipolytica*), and the like.

In various embodiments, strains that may be used in the practice of the disclosure including both prokaryotic and eukaryotic strains, are readily accessible to the public from a number of culture collections such as American Type Culture Collection (ATCC), Deutsche Sammlung von Mikroorganismen and Zellkulturen GmbH (DSM), Centraalbureau Voor Schimmelcultures (CBS), and Agricultural Research Service Patent Culture Collection, Northern Regional Research Center (NRRL).

In some embodiments, the methods of the present disclosure are also applicable to multi-cellular organisms. For example, the platform could be used for improving the performance of crops. The organisms can comprise a plurality of plants such as *Gramineae, Fetucoideae, Poacoideae, Agrostis, Phleum, Dactylis, Sorgum, Setaria, Zea, Oryza, Triticum, Secale, Avena, Hordeum, Saccharum, Poa, Festuca, Stenotaphrum, Cynodon, Coix, Olyreae, Phareae, Compositae* or *Leguminosae*. For example, the plants can be corn, rice, soybean, cotton, wheat, rye, oats, barley, pea, beans, lentil, peanut, yam bean, cowpeas, velvet beans, clover, alfalfa, lupine, vetch, lotus, sweet clover, wisteria, sweet pea, sorghum, millet, sunflower, canola or the like. Similarly, the organisms can include a plurality of animals such as non-human mammals, fish, insects, or the like.

*E. Coli* Host Cells

As aforementioned, *E. coli* host cells can be utilized in embodiments of the disclosure.

For example, suitable host strains of the *E. coli* species comprise: Enterotoxigenic *E. coli* (ETEC), Enteropathogenic *E. coli* (EPEC), Enteroinvasive *E. coli* (EIEC), Enterohemorrhagic *E. coli* (EHEC), Uropathogenic *E. coli*

(UPEC), Verotoxin-producing *E. coli, E. coli* O157:H7, *E. coli* O104:H4, *Escherichia coli* O121, *Escherichia coli* O104:H21, *Escherichia coli* K1, and *Escherichia coli* NC101. In some embodiments, the present disclosure teaches genomic engineering of *E. coli* K12, *E. coli* B, and *E. coli* C.

In some embodiments, the present disclosure teaches genomic engineering of *E. coli* strains NCTC 12757, NCTC 12779, NCTC 12790, NCTC 12796, NCTC 12811, ATCC 11229, ATCC 25922, ATCC 8739, DSM 30083, BC 5849, BC 8265, BC 8267, BC 8268, BC 8270, BC 8271, BC 8272, BC 8273, BC 8276, BC 8277, BC 8278, BC 8279, BC 8312, BC 8317, BC 8319, BC 8320, BC 8321, BC 8322, BC 8326, BC 8327, BC 8331, BC 8335, BC 8338, BC 8341, BC 8344, BC 8345, BC 8346, BC 8347, BC 8348, BC 8863, and BC 8864.

In some embodiments, the present disclosure teaches verocytotoxigenic *E. coli* (VTEC), such as strains BC 4734 (O26:H11), BC 4735 (O157:H-), BC 4736, BC 4737 (n.d.), BC 4738 (O157:H7), BC 4945 (O26:H-), BC 4946 (O157:H7), BC 4947 (O111:H-), BC 4948 (O157:H), BC 4949 (O5), BC 5579 (O157:H7), BC 5580 (O157:H7), BC 5582 (O3:H), BC 5643 (O2:H5), BC 5644 (O128), BC 5645 (O55:H-), BC 5646 (O69:H-), BC 5647 (O101:H9), BC 5648 (O103:H2), BC 5850 (O22:H8), BC 5851 (O55:H-), BC 5852 (O48:H21), BC 5853 (O26:H11), BC 5854 (O157:H7), BC 5855 (O157:H-), BC 5856 (O26:H-), BC 5857 (O103:H2), BC 5858 (O26:H11), BC 7832, BC 7833 (Oraw form:H-), BC 7834 (ONT:H-), BC 7835 (O103:H2), BC 7836 (O57:H-), BC 7837 (ONT:H-), BC 7838, BC 7839 (O128:H2), BC 7840 (O157:H-), BC 7841 (O23:H-), BC 7842 (O157:H-), BC 7843, BC 7844 (O157:H-), BC 7845 (O103:H2), BC 7846 (O26:H11), BC 7847 (O145:H-), BC 7848 (O157:H-), BC 7849 (O156:H47), BC 7850, BC 7851 (O157:H-), BC 7852 (O157:H-), BC 7853 (O5:H-), BC 7854 (O157:H7), BC 7855 (O157:H7), BC 7856 (O26:H-), BC 7857, BC 7858, BC 7859 (ONT:H-), BC 7860 (O129:H-), BC 7861, BC 7862 (O103:H2), BC 7863, BC 7864 (Oraw form:H-), BC 7865, BC 7866 (O26:H-), BC 7867 (Oraw form:H-), BC 7868, BC 7869 (ONT:H-), BC 7870 (O113:H-), BC 7871 (ONT:H-), BC 7872 (ONT:H-), BC 7873, BC 7874 (Oraw form:H-), BC 7875 (O157:H-), BC 7876 (O111:H-), BC 7877 (O146:H21), BC 7878 (O145:H-), BC 7879 (O22:H8), BC 7880 (Oraw form:H-), BC 7881 (O145:H-), BC 8275 (O157:H7), BC 8318 (O55:K-:H-), BC 8325 (O157:H7), and BC 8332 (ONT), BC 8333.

In some embodiments, the present disclosure teaches enteroinvasive *E. coli* (EIEC), such as strains BC 8246 (O152:K-:H-), BC 8247 (O124:K(72):H3), BC 8248 (O124), BC 8249 (O112), BC 8250 (O136:K(78):H-), BC 8251 (O124:H-), BC 8252 (O144:K-:H-), BC 8253 (O143:K:H-), BC 8254 (O143), BC 8255 (O112), BC 8256 (O28a.e), BC 8257 (O124:H-), BC 8258 (O143), BC 8259 (O167:K-:H5), BC 8260 (O128a.c.:H35), BC 8261 (O164), BC 8262 (O164:K-:H-), BC 8263 (O164), and BC 8264 (O124).

In some embodiments, the present disclosure teaches enterotoxigenic *E. coli* (ETEC),such as strains BC 5581 (O78:H11), BC 5583 (O2:K1), BC 8221 (O118), BC 8222 (O148:H-), BC 8223 (O111), BC 8224 (O110:H-), BC 8225 (O148), BC 8226 (O118), BC 8227 (O25:H42), BC 8229 (O6), BC 8231 (O153:H45), BC 8232 (O9), BC 8233 (O148), BC 8234 (O128), BC 8235 (O118), BC 8237 (O111), BC 8238 (O110:H17), BC 8240 (O148), BC 8241 (O6H16), BC 8243 (O153), BC 8244 (O15:H-), BC 8245 (O20), BC 8269 (O125a.c:H-), BC 8313 (O6:H6), BC 8315 (O153:H-), BC 8329, BC 8334 (O118:H12), and BC 8339.

In some embodiments, the present disclosure teaches enteropathogenic *E. coli* (EPEC), such as strains BC 7567 (O86), BC 7568 (O128), BC 7571 (O114), BC 7572 (O119), BC 7573 (O125), BC 7574 (O124), BC 7576 (O127a), BC 7577 (O126), BC 7578 (O142), BC 7579 (O26), BC 7580 (O1(26), BC 7581 (O142), BC 7582 (O55), BC 7583 (O158), BC 7584 (O-), BC 7585 (O-), BC 7586 (O-), BC 8330, BC 8550 (O26), BC 8551 (O55), BC 8552 (O158), BC 8553 (O26), BC 8554 (O158), BC 8555 (O86), BC 8556 (O128), BC 8557 (OK26), BC 8558 (O55), BC 8560 (O158), BC 8561 (O158), BC 8562 (O114), BC 8563 (O86), BC 8564 (O128), BC 8565 (O158), BC 8566 (O158), BC 8567 (O158), BC 8568 (O111), BC 8569 (O128), BC 8570 (O114), BC 8571 (O128), BC 8572 (O128), BC 8573 (O158), BC 8574 (O158), BC 8575 (O158), BC 8576 (O158), BC 8577 (O158), BC 8578 (O158), BC 8581 (O158), BC 8583 (O128), BC 8584 (O158), BC 8585 (O128), BC 8586 (O158), BC 8588 (O26), BC 8589 (O86), BC 8590 (O127), BC 8591 (O128), BC 8592 (O114), BC 8593 (O114), BC 8594 (O114), BC 8595 (O125), BC 8596 (O158), BC 8597 (O26), BC 8598 (O26), BC 8599 (O158), BC 8605 (O158), BC 8606 (O158), BC 8607 (O158), BC 8608 (O128), BC 8609 (O55), BC 8610 (O114), BC 8615 (O158), BC 8616 (O128), BC 8617 (O26), BC 8618 (O86), BC 8619 (O26), BC 8620 (O26), BC 8621 (O26), BC 8622, BC 8623, BC 8624 (O158), and BC 8625 (O158).

Cell Fermentation and Culture

Microorganisms of the present disclosure including those genetically engineered as described herein can be cultured in conventional nutrient media modified as appropriate for any desired biosynthetic reactions or selections. In some embodiments, the present disclosure teaches culture in inducing media for activating promoters. In some embodiments, the present disclosure teaches media with selection agents, including selection agents of transformants (e.g., antibiotics), or selection of organisms suited to grow under inhibiting conditions (e.g., high ethanol conditions). In some embodiments, the present disclosure teaches growing cell cultures in media optimized for cell growth. In other embodiments, the present disclosure teaches growing cell cultures in media optimized for product yield such as, for example, products or biomolecules of interest derived from metabolic processing of glucose. In some embodiments, the present disclosure teaches growing cultures in media capable of inducing cell growth and also contains the necessary precursors for final product production (e.g., high levels of sugars for ethanol production).

The biomolecules or products of interest produced by the methods provided herein can be any commercial product produced from glucose. In some cases, the biomolecule or product of interest is a small molecule, an amino acid, an organic acid, or an alcohol. The amino acid can be, without limitation, tyrosine, phenylalanine, tryptophan, aspartic acid, asparagine, threonine, isoleucine, methionine, or lysine. In specific embodiments, the amino acid is lysine. In certain aspects, the lysine is L-lysine. The organic acid can be, without limitation, succinate, lactate or pyruvate. The alcohol can be, without limitation, ethanol or isobutanol.

Culture conditions, such as temperature, pH and the like, are those suitable for use with the host cell selected for expression, and will be apparent to those skilled in the art. As noted, many references are available for the culture and production of many cells, including cells of bacterial, plant, animal (including mammalian) and archebacterial origin. See e.g., Sambrook, Ausubel (all supra), as well as Berger, *Guide to Molecular Cloning Techniques, Methods in Enzymology* volume 152 Academic Press, Inc., San Diego, Calif.;

and Freshney (1994) *Culture of Animal Cells, a Manual of Basic Technique*, third edition, Wiley-Liss, New York and the references cited therein; Doyle and Griffiths (1997) *Mammalian Cell Culture: Essential Techniques* John Wiley and Sons, NY; Humason (1979) *Animal Tissue Techniques*, fourth edition W.H. Freeman and Company; and Ricciardelle et al., (1989) *In Vitro Cell Dev. Biol.* 25:1016-1024, all of which are incorporated herein by reference. For plant cell culture and regeneration, Payne et al. (1992) *Plant Cell and Tissue Culture in Liquid Systems* John Wiley & Sons, Inc. New York, N.Y.; Gamborg and Phillips (eds) (1995) *Plant Cell, Tissue and Organ Culture*; Fundamental Methods Springer Lab Manual, Springer-Verlag (Berlin Heidelberg N.Y.); Jones, ed. (1984) *Plant Gene Transfer and Expression Protocols*, Humana Press, Totowa, N.J. and *Plant Molecular Biology* (1993) R. R. D. Croy, Ed. Bios Scientific Publishers, Oxford, U.K. ISBN 0 12 198370 6, all of which are incorporated herein by reference. Cell culture media in general are set forth in Atlas and Parks (eds.) *The Handbook of Microbiological Media* (1993) CRC Press, Boca Raton, Fla., which is incorporated herein by reference. Additional information for cell culture is found in available commercial literature such as the *Life Science Research Cell Culture Catalogue* from Sigma-Aldrich, Inc (St Louis, Mo.) ("Sigma-LSRCCC") and, for example, *The Plant Culture Catalogue* and supplement also from Sigma-Aldrich, Inc (St Louis, Mo.) ("Sigma-PCCS"), all of which are incorporated herein by reference.

The culture medium or fermentation medium to be used must in a suitable manner satisfy the demands of the respective strains. Descriptions of culture media for various microorganisms are present in the "Manual of Methods for General Bacteriology" of the American Society for Bacteriology (Washington D.C., USA, 1981). The terms culture medium and fermentation medium are interchangeable.

In some embodiments, the present disclosure teaches that the microorganisms produced may be cultured continuously—as described, for example, in WO 05/021772—or discontinuously in a batch process (batch cultivation) or in a fed-batch or repeated fed-batch process for the purpose of producing the desired organic-chemical compound. A summary of a general nature about known cultivation methods is available in the textbook by Chmiel (Bioprozeßtechnik. 1: Einführung in die Bioverfahrenstechnik (Gustav Fischer Verlag, Stuttgart, 1991)) or in the textbook by Storhas (Bioreaktoren and periphere Einrichtungen (Vieweg Verlag, Braunschweig/Wiesbaden, 1994)).

In some embodiments, the cells of the present disclosure are grown under batch or continuous fermentations conditions. Classical batch fermentation is a closed system, wherein the compositions of the medium is set at the beginning of the fermentation and is not subject to artificial alternations during the fermentation. A variation of the batch system is a fed-batch fermentation which also finds use in the present disclosure. In this variation, the substrate is added in increments as the fermentation progresses. Fed-batch systems are useful when catabolite repression is likely to inhibit the metabolism of the cells and where it is desirable to have limited amounts of substrate in the medium. Batch and fed-batch fermentations are common and well known in the art. Continuous fermentation is a system where a defined fermentation medium is added continuously to a bioreactor and an equal amount of conditioned medium is removed simultaneously for processing and harvesting of desired proteins. In some embodiments, continuous fermentation generally maintains the cultures at a constant high density where cells are primarily in log phase growth. In some embodiments, continuous fermentation generally maintains the cultures at a stationary or late log/stationary, phase growth. Continuous fermentation systems strive to maintain steady state growth conditions.

Methods for modulating nutrients and growth factors for continuous fermentation processes as well as techniques for maximizing the rate of product formation are well known in the art of industrial microbiology.

For example, a non-limiting list of carbon sources for the cultures of the present disclosure include, sugars and carbohydrates such as, for example, glucose, sucrose, lactose, fructose, maltose, molasses, sucrose-containing solutions from sugar beet or sugar cane processing, starch, starch hydrolysate, and cellulose; oils and fats such as, for example, soybean oil, sunflower oil, groundnut oil and coconut fat; fatty acids such as, for example, palmitic acid, stearic acid, and linoleic acid; alcohols such as, for example, glycerol, methanol, and ethanol; and organic acids such as, for example, acetic acid or lactic acid.

A non-limiting list of the nitrogen sources for the cultures of the present disclosure include, organic nitrogen-containing compounds such as peptones, yeast extract, meat extract, malt extract, corn steep liquor, soybean flour, and urea; or inorganic compounds such as ammonium sulfate, ammonium chloride, ammonium phosphate, ammonium carbonate, and ammonium nitrate. The nitrogen sources can be used individually or as a mixture.

A non-limiting list of the possible phosphorus sources for the cultures of the present disclosure include, phosphoric acid, potassium dihydrogen phosphate or dipotassium hydrogen phosphate or the corresponding sodium-containing salts. The culture medium may additionally comprise salts, for example in the form of chlorides or sulfates of metals such as, for example, sodium, potassium, magnesium, calcium and iron, such as, for example, magnesium sulfate or iron sulfate, which are necessary for growth. Finally, essential growth factors such as amino acids, for example homoserine and vitamins, for example thiamine, biotin or pantothenic acid, may be employed in addition to the abovementioned substances.

In some embodiments, the pH of the culture can be controlled by any acid or base, or buffer salt, including, but not limited to sodium hydroxide, potassium hydroxide, ammonia, or aqueous ammonia; or acidic compounds such as phosphoric acid or sulfuric acid in a suitable manner. In some embodiments, the pH is generally adjusted to a value of from 6.0 to 8.5, preferably 6.5 to 8.

In some embodiments, the cultures of the present disclosure may include an anti-foaming agent such as, for example, fatty acid polyglycol esters. In some embodiments the cultures of the present disclosure are modified to stabilize the plasmids of the cultures by adding suitable selective substances such as, for example, antibiotics.

In some embodiments, the culture is carried out under aerobic conditions. In order to maintain these conditions, oxygen or oxygen-containing gas mixtures such as, for example, air are introduced into the culture. It is likewise possible to use liquids enriched with hydrogen peroxide. The fermentation is carried out, where appropriate, at elevated pressure, for example at an elevated pressure of from 0.03 to 0.2 MPa. The temperature of the culture is normally from 20° C. to 45° C. and preferably from 25° C. to 40° C., particularly preferably from 30° C. to 37° C. In batch or fed-batch processes, the cultivation is preferably continued until an amount of the desired product of interest (e.g. an organic-chemical compound) sufficient for being recovered has formed. This aim can normally be achieved within 10 hours to 160 hours. In continuous processes, longer cultivation times are possible. The activity of the microorganisms results in a concentration (accumulation) of the product of interest in the fermentation medium and/or in the cells of said microorganisms.

In some embodiments, the culture is carried out under anaerobic conditions.

Screening

In some embodiments, the present disclosure teaches high-throughput initial screenings. In other embodiments, the present disclosure also teaches robust tank-based validations of performance data.

In some embodiments, the high-throughput screening process is designed to predict performance of strains in bioreactors. As previously described, culture conditions are selected to be suitable for the organism and reflective of bioreactor conditions. Individual colonies are picked and transferred into 96 well plates and incubated for a suitable amount of time. Cells are subsequently transferred to new 96 well plates for additional seed cultures, or to production cultures. Cultures are incubated for varying lengths of time, where multiple measurements may be made. These may include measurements of product, biomass or other characteristics that predict performance of strains in bioreactors. High-throughput culture results are used to predict bioreactor performance.

In some embodiments, the tank-based performance validation is used to confirm performance of strains isolated by high throughput screening. Fermentation processes/conditions are designed to replicate commercial reactor conditions. Candidate strains are screened using bench scale fermentation reactors for relevant strain performance characteristics such as productivity or yield.

Product Recovery and Quantification

Methods for screening for the production of products of interest are known to those of skill in the art and are discussed throughout the present specification. Such methods may be employed when screening the strains of the disclosure. The biomolecules or products of interest produced by the methods provided herein can be any commercial product produced from glucose. In some cases, the biomolecule or product of interest is an amino acid, an organic acid, or an alcohol. The amino acid can be, without limitation, tyrosine, phenylalanine, tryptophan, aspartic acid, asparagine, threonine, isoleucine, methionine, or lysine. In specific embodiments, the amino acid is lysine. In certain aspects, the lysine is L-lysine. The organic acid can be, without limitation, succinate, lactate or pyruvate. The alcohol can be, without limitation, ethanol or isobutanol.

In some embodiments, the present disclosure teaches methods of improving strains designed to produce non-secreted intracellular products. For example, the present disclosure teaches methods of improving the robustness, yield, efficiency, or overall desirability of cell cultures producing intracellular enzymes, oils, pharmaceuticals, or other valuable small molecules or peptides. The recovery or isolation of non-secreted intracellular products can be achieved by lysis and recovery techniques that are well known in the art, including those described herein.

For example, in some embodiments, cells of the present disclosure can be harvested by centrifugation, filtration, settling, or other method. Harvested cells are then disrupted by any convenient method, including freeze-thaw cycling, sonication, mechanical disruption, or use of cell lysing agents, or other methods, which are well known to those skilled in the art.

The resulting product of interest, e.g. a polypeptide, may be recovered/isolated and optionally purified by any of a number of methods known in the art. For example, a product polypeptide may be isolated from the nutrient medium by conventional procedures including, but not limited to: centrifugation, filtration, extraction, spray-drying, evaporation, chromatography (e.g., ion exchange, affinity, hydrophobic interaction, chromatofocusing, and size exclusion), or precipitation. Finally, high performance liquid chromatography (HPLC) can be employed in the final purification steps. (See for example Purification of intracellular protein as described in Parry et al., 2001, *Biochem.* 1353:117, and Hong et al., 2007, *Appl. Microbiol. Biotechnol.* 73:1331, both incorporated herein by reference).

In addition to the references noted supra, a variety of purification methods are well known in the art, including, for example, those set forth in: Sandana (1997) *Bioseparation of Proteins*, Academic Press, Inc.; Bollag et al. (1996) *Protein Methods*, 2$^{nd}$ Edition, Wiley-Liss, NY; Walker (1996) *The Protein Protocols Handbook* Humana Press, NJ; Harris and Angal (1990) *Protein Purification Applications: A Practical Approach*, IRL Press at Oxford, Oxford, England; Harris and Angal *Protein Purification Methods: A Practical Approach*, IRL Press at Oxford, Oxford, England; Scopes (1993) *Protein Purification: Principles and Practice* 3$^{rd}$ Edition, Springer Verlag, NY; Janson and Ryden (1998) *Protein Purification: Principles, High Resolution Methods and Applications*, Second Edition, Wiley-VCH, NY; and Walker (1998) *Protein Protocols on CD-ROM*, Humana Press, NJ, all of which are incorporated herein by reference.

In some embodiments, the present disclosure teaches the methods of improving strains designed to produce secreted products. For example, the present disclosure teaches methods of improving the robustness, yield, efficiency, or overall desirability of cell cultures producing valuable small molecules or peptides.

In some embodiments, immunological methods may be used to detect and/or purify secreted or non-secreted products produced by the cells of the present disclosure. In one example approach, antibody raised against a product molecule (e.g., against an insulin polypeptide or an immunogenic fragment thereof) using conventional methods is immobilized on beads, mixed with cell culture media under conditions in which the endoglucanase is bound, and precipitated. In some embodiments, the present disclosure teaches the use of enzyme-linked immunosorbent assays (ELISA).

In other related embodiments, immunochromatography is used, as disclosed in U.S. Pat. Nos. 5,591,645, 4,855,240, 4,435,504, 4,980,298, and Se-Hwan Paek, et al., "Development of rapid One-Step Immunochromatographic assay, Methods", 22, 53-60, 2000), each of which are incorporated by reference herein. A general immunochromatography detects a specimen by using two antibodies. A first antibody exists in a test solution or at a portion at an end of a test piece in an approximately rectangular shape made from a porous membrane, where the test solution is dropped. This antibody is labeled with latex particles or gold colloidal particles (this antibody will be called as a labeled antibody hereinafter). When the dropped test solution includes a specimen to be detected, the labeled antibody recognizes the specimen so as to be bonded with the specimen. A complex of the specimen and labeled antibody flows by capillarity toward an absorber, which is made from a filter paper and attached to an end opposite to the end having included the labeled antibody. During the flow, the complex of the specimen and labeled antibody is recognized and caught by a second antibody (it will be called as a tapping antibody hereinafter) existing at the middle of the porous membrane and, as a result of this, the complex appears at a detection part on the porous membrane as a visible signal and is detected.

In some embodiments, the screening methods of the present disclosure are based on photometric detection techniques (absorption, fluorescence). For example, in some embodiments, detection may be based on the presence of a fluorophore detector such as GFP bound to an antibody. In other embodiments, the photometric detection may be based on the accumulation on the desired product from the cell culture. In some embodiments, the product may be detectable via UV of the culture or extracts from said culture.

In some embodiments, the product recovery methods allow for the quantitative determination of the effect on performance of each candidate gapA/transhydrogenase/gdh, asd, dapB, and/or ddh gene. In some embodiments, the product recovery methods allow for the quantitative determination of the effect on performance of each candidate gapA/transhydrogenase/gdh, asd, dapB, and/or ddh gene combination, allowing for comparison of each and selection for the optimal combination.

A non-limiting list of products produced and recovered via the methods and organisms of the present disclosure is provided in Table 2.

TABLE 2 products of the present disclosure (referred to as products of interest, compounds produced, etc.)

Polyketides

| | | | |
|---|---|---|---|
| pikromycin | erythromycin A | clarithromycin | azithromycin |
| Avermectin | ivermectin | spinosad | geldanamycin |
| macbecin | amphotericin | nystatin | pimaricin |
| monensin | doxycycline | bullatacin | squamocin |
| molvizarin | uvaricin | annonacin | tacrolimus |
| sirolimus | radicicol | lovastatin | discodermolide |
| aflatoxin | usnic acid, | anthramycin | |

Catechins

| | | | |
|---|---|---|---|
| epicatechin | epigallocatechin | epicatechin gallate | epigallocatechin gallate |
| epiafzelechin robinetinidol | fisetinidol | guibourtinidol | mesquitol |

Terpenes

| | | | |
|---|---|---|---|
| prenol | isovaleric acid | geraniol | terpineol |
| limonene | myrcene | linalool | pinene |
| humulene | farnesenes | farnesol | cafestol |
| kahweol | cembrene | taxadiene | retinol |
| retinal | phytol | geranylfarnesol | squalene |
| lanosterol | cycloartenol | cholesterol | ferrugicadiol |
| tetraprenylcurcumene | lycopene | gamma-carotene | alpha- and beta-carotenes |
| 3-oxo-α-ionol | 7,8-dihydroionone | megastigmane-3,9-diol | 3-oxo-7,8-dihydro-α-ionol |

Fatty Acids

| | | | |
|---|---|---|---|
| myristoleic acid | palmitoleic acid | sapienic acid | oleic acid |
| elaidic acid | vaccenic acid | linoleic acid | linoelaidic acid |
| α-linolenic acid | arachidonic acid | eicosapentaenoic acid | erucic acid |
| docosahexaenoic acid | caprylic acid | capric acid | lauric acid |
| myristic acid | palmitic acid | stearic acid | arachidic acid |
| behenic acid | lignoceric acid | cerotic acid | |

Amino Acids or Derivatives Thereof

| | | | |
|---|---|---|---|
| S-adenosyl methionine | isoleucine | leucine | valine |
| methionine | threonine | lysine | glutamate |
| tryptophan | tyrosine | L-lysine | phenylalanine |

Chorismate Pathway Compounds

| | | | |
|---|---|---|---|
| Indole | chorismate | shikimate | salicylic acid |
| 2,3-dihydroxybenzoic acid | para-aminobenzoate | vitamin k | folate |

Alkaloids

| | | | |
|---|---|---|---|
| ephedrine | homoharringtonine | galantamine | vincamine |
| quinidine | morphine | chelerythrine | piperine |
| caffeine | nicotine | theobromine | quinine |

Persons having skill in the art will recognize that the methods of the present disclosure are compatible with host cells producing any desirable biomolecule product of interest.

Selection Criteria and Goals

The selection of a particular strain of host cell expressing a heterologous gapA/nicotinamide nucleotide transhydrogenase/threonine aldolase/pyruvate carboxylase/gdh, asd, dapB, and/or ddh can be based on specific goals. For example, in some embodiments, the program goal may be to maximize single batch yields of reactions with no immediate time limits. In other embodiments, the program goal may be to rebalance biosynthetic yields to produce a specific product, or to produce a particular ratio of products. In some embodiments, the program goal may be to improve performance characteristics such as yield, titer, productivity, by-product elimination, tolerance to process excursions, optimal growth temperature and growth rate. In some embodiments, the program goal is improved host performance as measured by volumetric productivity, specific productivity, yield or titre, of a product of interest produced by a microbe.

In other embodiments, the program goal may be to optimize synthesis efficiency of a commercial strain in terms of final product yield per quantity of inputs (e.g., total amount of ethanol produced per pound of sucrose). In other embodiments, the program goal may be to optimize synthesis speed, as measured for example in terms of batch completion rates, or yield rates in continuous culturing systems. In one embodiment, the program goal is to optimize final product yield and/or production rate of a biomolecule or product of interest. The biomolecules or products of interest produced by the methods provided herein can be any commercial product produced from glucose. In some cases, the biomolecule or product of interest is a small molecule, an amino acid, an organic acid, or an alcohol. The amino acid can be, without limitation, tyrosine, phenylalanine, tryptophan, aspartic acid, asparagine, threonine, isoleucine, methionine, or lysine. In specific embodiments, the amino acid is lysine. In certain aspects, the lysine is L-lysine. In certain aspects, the threonine is L-threonine. The organic acid can be, without limitation, succinate, lactate or pyruvate. The alcohol can be, without limitation, ethanol or isobutanol.

Persons having ordinary skill in the art will recognize how to tailor strain selection criteria to meet the particular project goal. For example, selections of a strain's single batch max yield at reaction saturation may be appropriate for identifying strains with high single batch yields. Selection based on consistency in yield across a range of temperatures and conditions may be appropriate for identifying strains with increased robustness and reliability.

In some embodiments, the selection criteria for the initial phase and the tank-based validation will be identical. In other embodiments, tank-based selection may operate under additional and/or different selection criteria.

Sequencing

In some embodiments, the present disclosure teaches whole-genome sequencing of the organisms described herein. In other embodiments, the present disclosure also teaches sequencing of plasmids, PCR products, and other oligos as quality controls to the methods of the present disclosure. Sequencing methods for large and small projects are well known to those in the art.

In some embodiments, any high-throughput technique for sequencing nucleic acids can be used in the methods of the disclosure. In some embodiments, the present disclosure teaches whole genome sequencing. In other embodiments, the present disclosure teaches amplicon sequencing ultra deep sequencing to identify genetic variations. In some embodiments, the present disclosure also teaches novel methods for library preparation, including tagmentation (see WO/2016/073690). DNA sequencing techniques include classic dideoxy sequencing reactions (Sanger method) using labeled terminators or primers and gel separation in slab or capillary; sequencing by synthesis using reversibly terminated labeled nucleotides, pyrosequencing; 454 sequencing; allele specific hybridization to a library of labeled oligonucleotide probes; sequencing by synthesis using allele specific hybridization to a library of labeled clones that is followed by ligation; real time monitoring of the incorporation of labeled nucleotides during a polymerization step; polony sequencing; and SOLiD sequencing.

In one aspect of the disclosure, high-throughput methods of sequencing are employed that comprise a step of spatially isolating individual molecules on a solid surface where they are sequenced in parallel. Such solid surfaces may include nonporous surfaces (such as in Solexa sequencing, e.g. Bentley et al, Nature, 456: 53-59 (2008) or Complete Genomics sequencing, e.g. Drmanac et al, Science, 327: 78-81 (2010)), arrays of wells, which may include bead- or particle-bound templates (such as with 454, e.g. Margulies et al, Nature, 437: 376-380 (2005) or Ion Torrent sequencing, U.S. patent publication 2010/0137143 or 2010/0304982), micromachined membranes (such as with SMRT sequencing, e.g. Eid et al, Science, 323: 133-138 (2009)), or bead arrays (as with SOLiD sequencing or polony sequencing, e.g. Kim et al, Science, 316: 1481-1414 (2007)).

In another embodiment, the methods of the present disclosure comprise amplifying the isolated molecules either before or after they are spatially isolated on a solid surface. Prior amplification may comprise emulsion-based amplification, such as emulsion PCR, or rolling circle amplification. Also taught is Solexa-based sequencing where individual template molecules are spatially isolated on a solid surface, after which they are amplified in parallel by bridge PCR to form separate clonal populations, or clusters, and then sequenced, as described in Bentley et al (cited above) and in manufacturer's instructions (e.g. TruSeq™ Sample Preparation Kit and Data Sheet, Illumina, Inc., San Diego, Calif., 2010); and further in the following references: U.S. Pat. Nos. 6,090,592; 6,300,070; 7,115,400; and EP0972081B1; which are incorporated by reference.

In one embodiment, individual molecules disposed and amplified on a solid surface form clusters in a density of at least $10^5$ clusters per $cm^2$; or in a density of at least $5\times10^5$ per $cm^2$; or in a density of at least $10^6$ clusters per $cm^2$. In one embodiment, sequencing chemistries are employed having relatively high error rates. In such embodiments, the average quality scores produced by such chemistries are monotonically declining functions of sequence read lengths. In one embodiment, such decline corresponds to 0.5 percent of sequence reads have at least one error in positions 1-75; 1 percent of sequence reads have at least one error in positions 76-100; and 2 percent of sequence reads have at least one error in positions 101-125.

Sequence Variants

In some embodiments, the modified GAPDH comprises an amino acid sequence that shares at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to the amino acid sequence of SEQ ID NO:58. In some embodiments, the modified GAPDH comprises an amino acid sequence that shares at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to an amino acid sequence selected from the group consisting of SEQ ID NO:294, 296, 233, 234, 235, 236, 298, and 300. In some embodiments, wherein the variant of gdh enzyme comprises an amino acid sequence that shares at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to the amino acid sequence of SEQ ID NO:42 or 44. In some embodiments, the variant enzyme of asd comprises an amino acid sequence that shares at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to the amino acid sequence of SEQ ID NO:30 or 40. In some embodiments, the variant enzyme of dapB comprises an amino acid sequence that shares at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to the amino acid sequence of SEQ ID NO:46 or 48. In some embodiments, the variant enzyme of ddh comprises an amino acid sequence that shares at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to the amino acid sequence of SEQ ID NO:4.

In some embodiments, the variant enzyme of gdh comprises an amino acid sequence that shares at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to an amino acid sequence selected from the group consisting of SEQ ID NO: 132, 134, 136, 138, 140, 142, 144, 146, 148, 150, 152, 154, 156, 158, 160, 162, 164, 166, 168, 170, 172, 174, 176, 178, 180, and 182. In some embodiments, the variant enzyme of asd comprises an amino acid sequence that shares at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to an amino acid sequence selected from the group consisting of SEQ ID NO: 80, 82, 84, 86, 88, 90, 92, 94, 96, 98, 100, 102, 104, 106, 108, 110, 112, 114, 116, 118, 120, 122, 124, 126, 128, and 130. In some embodiments, the variant enzyme of threonine aldolase comprises an amino acid sequence that shares at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to an amino acid sequence selected from the group consisting of SEQ ID NO: 184, 186, 188, 190, 192, 194, 196, 198, 200, 202, 204, 206, 208, 210, 212, 214, 216, 218, 220, 222, 224, 226, 228, 230, and 232.

In some embodiments, the multi-copy replicating plasmid comprises a sequence at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to the thrABC operon sequence of SEQ ID NO:77. In some embodiments, the recombinant protein fragment of gapA comprises a sequence at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to an amino acid sequence selected from the group consisting of SEQ ID NO: 233, 234, 235, 236, and 298.

EXAMPLES

The following Examples are given for the purpose of illustrating various embodiments of the disclosure and are not meant to limit the present disclosure in any fashion. Changes therein and other uses which are encompassed within the spirit of the disclosure, as defined by the scope of the claims, will be recognized by those skilled in the art.

These Examples demonstrate methods to increase the production of products of interest in a host cell, which are limited by the availability of NADPH. The taught methods of the disclosure can be utilized to increase the production of any product of interest that relies upon the availability of NADPH in its metabolic pathways. For example, the disclosure provides for methods of increasing the production of amino acids such as L-lysine or L-threonine, which are two products of interest whos production is limited by the availability of NADPH in a cell.

It is known that NADPH is a limiting factor in L-lysine and L-threonine production in bacteria. Therefore, these examples illustrate six strategies to overcome limits on NADPH availability in host cells, which leads to increased L-lysine or L-threonine production. These strategies are: (1) engineering the glycolytic pathway to produce NADPH by broadening the coenzyme specificity of the endogenous glycolytic enzyme Glyceraldehyde-3-phosphate dehydrogenase (gapA) such that the enzyme possesses dual specificity for NADP and NAD; (2) expressing a transhydrogenase enzyme in the host cell that generates NADPH from NADH; (3) reprogramming synthesis of aspartate semialdehyde (ASA) which is a precursor for lysine, threonine, isoleucine, and methionine by expressing homologues of endogenous gdh and/or asd enzymes that use NADH more effectively than NADPH as a cofactor; (4) reprogramming the DAP-pathway for lysine synthesis by expressing homologues of the endogenous dapB and/or ddh enzymes that use NADH more effectively than NADPH as a cofactor; (5) reprogramming threonine synthesis by expressing homologues of the endogenous ItA that decrease or reverse degradation of threonine to glycine; and (6) expressing a heterologous pyruvate carboxylase (PyC) or homologues thereof to increase synthesis of oxaloacetate, or increasing expression of an endogenous PyC. In one embodiment, the target organism is *E. coli*. In one embodiment, the target organism is *Corynebacterium* sp.

A brief table of contents is provided below solely for the purpose of assisting the reader. Nothing in this table of contents is meant to limit the scope of the examples or disclosure of the application.

TABLE 3

Table of Contents For Example Section

| Example # | Title | Brief Description |
|---|---|---|
| 1 | Broadening the Coenzyme Specificity of Glyceraldehyde 3-phosphate dehydrogenase (GAPDH) - Lysine | Describes the improvement in lysine productivity in *C. glutamicum* achieved by broadening the coenzyme specificity of gapA to include NADP. |

TABLE 3-continued

Table of Contents For Example Section

| Example # | Title | Brief Description |
|---|---|---|
| 2 | Construction of a Threonine-Producing Base Strain of E. coli K-12 strain, W3110 | Describes constructing an E. coli base strain adapted for producing threonine, which is used in Examples 3 and 5-7. |
| 3 | Broadening the Coenzyme Specificity of Glyceraldehyde 3-phosphate dehydrogenase (GAPDH) - Threonine | Describes the improvement in threonine productivity in E. coli achieved by broadening the coenzyme specificity of gapA to include NADP. |
| 4 | Reprogramming the DAP-Pathway for Lysine Synthesis by Utilizing Variant Enzymes with Cofactor Specificity for NADH | Describes the improvement in lysine productivity in C. glutamicum achieved by replacing gdh, asd, dapB and ddh with homologs from other bacteria. |
| 5 | Reprogramming the Threonine Biosynthesis Pathway by Utilizing Variant Enzymes with Cofactor Specificity for NADH | Describes the improvement in threonine productivity in E. coli achieved by replacing gdh and asd with homologs from other bacteria identified computationally from an in-house metagenomics library developed from environmental samples. |
| 6 | Improving Threonine Titer by Utilizing Variant Threonine Aldolase Enzymes with Different Substrate Preferences and Enzyme Kinetics | Describes the improvement in threonine productivity in E. coli achieved by replacing threonine adolase gene with genes identified computationally from an in-house metagenomics library developed from environmental samples or with Cronobactor sakazakaii threonine aldolase. |
| 7 | Expressing Combinations of Modified or Variant gapA, gdh, asd, and ltaE Enzymes in E. coli to Increase L-threonine Production | Describes combinining gapA, gdh/asd, and TA strategies to achieve greater improvements in threonine production in E. coli. |
| 8 | Expressing Transhydrogenase to Create NADPH from NADH | Describes improving lysine productivity in C. glutamicum by expressing a transhydrogenase capable of converting NADP to NADPH. |
| 9 | Expressing pyruvate carboxylase | Describes improving lysine or threonine production by expression of a pyruvate carboxylase. |
| 10 | Expressing Combinations of Modified gapA, Transhydrogenase, and Modified gdh, asd, dapB, and ddh Enzymes in C. glutamicum or E. coli to Increase L-Lysine or L-threonine Production | Desribes further improvement in lysine or threonine production in C. glutamicum or E. coli by combinantions of the strategies explored in Examples 1-9. |
| 11 | Identification of Novel Glyceraldehyde 3-phosphate dehydrogenase (GAPDH) Alleles | Random mutagenesis is used to identify new gapA alleles |

Example 1: Broadening the Coenzyme Specificity of Glyceraldehyde 3-Phosphate Dehydrogenase (GAPDH)—Lysine Glyceraldehyde-3-phosphate dehydrogenase (GAPDH) is an enzyme involved in the central carbon metabolic pathway. The most common form of GAPDH is the NAD-dependent enzyme gapA found in all organisms so far studied. This enzyme is encoded by the gapA gene, and converts glyceraldehyde-3-phosphate to glycerate-1,3-bisphosphate. The amino acid sequence of the gapA enzyme from C. glutamicum is as follows:

(SEQ ID NO: 58)
MTIRVGINGFGRIGRNFFRAILERSDDLEVVAVNDLTDNKTLSTLLKFDSI

MGRLGQEVEYDDDSITVGGKRIAVYAERDPKNLDWAAHNVDIVIESTGFFT

DANAAKAHIEAGAKKVIISAPASNEDATFVYGVNHESYDPENHNVISGASC

TTNCLAPMAKVLNDKFGIENGLMTTVHAYTGDQRLHDAPHRDLRRARAAAV

NIVPTSTGAAKAVALVLPELKGKLDGYALRVPVITGSATDLTFNTKSEVTV

ESINAAIKEAAVGEFGETLAYSEEPLVSTDIVHDSHGSIFDAGLTKVSGNT

VKVVSWYDNEWGYTCQLLRLTELVASKL.

Figure 1:
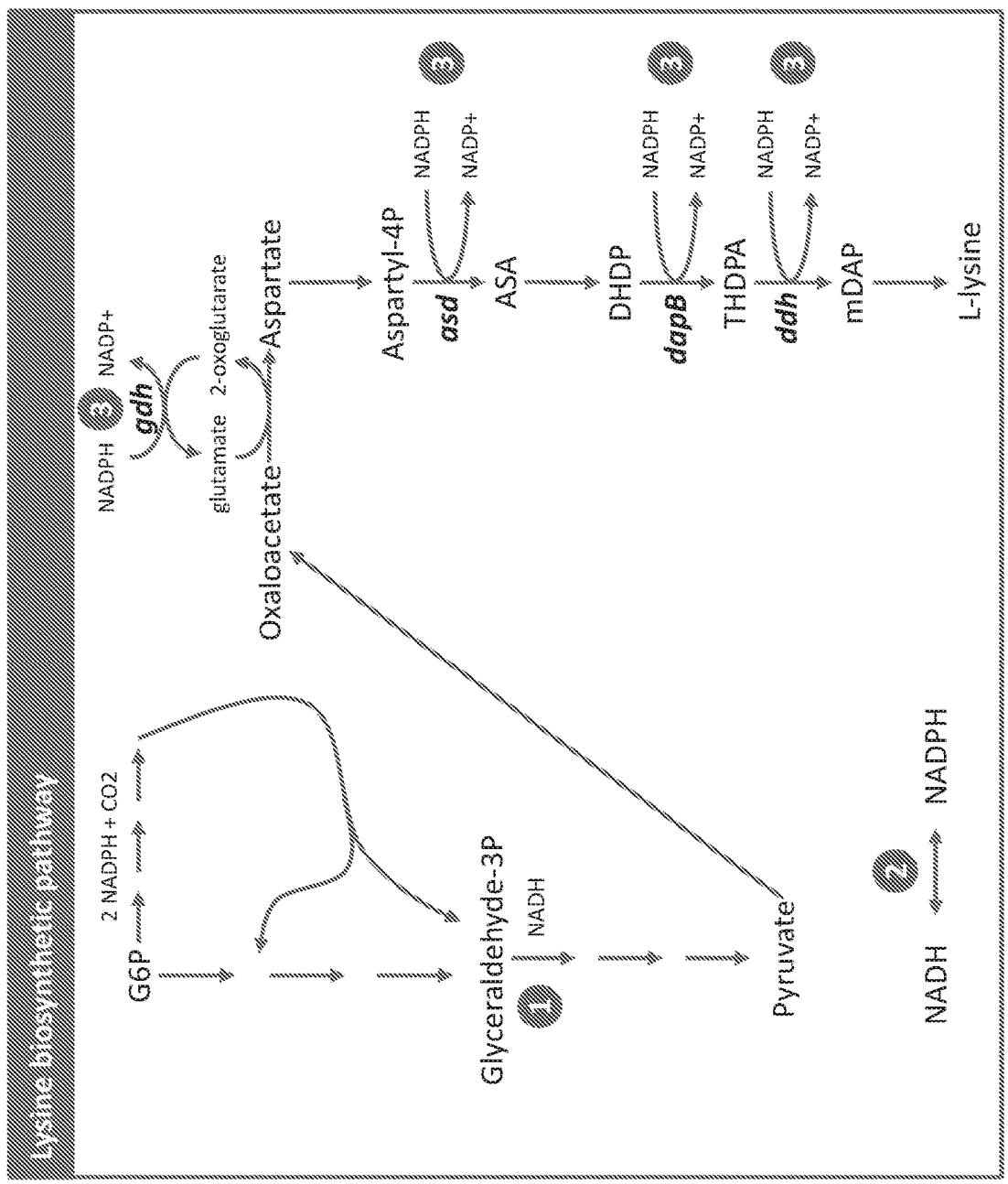
FIG. 1 illustrates the bacterial lysine biosynthetic pathway, and outlines the strategies employed in the present application to improve yield and productivity of L-lysine in bacteria. Efficiency of L-lysine production by a host cell can be improved by one or more of the following: (1) modifying an endogenous GAPDH such that the modified GAPDH has an increased specificity to coenzyme NADP relative to the corresponding naturally occurring GAPDH, resulting in production of NADPH; (2) expressing, in the host cell, a variant enzyme of one or more of the enzymes glutamate dehydrogenase (gdh), aspartate semialdehyde dehydrogenase (asd), dihydropicolinate reductase (dapB), and meso-diaminopimelate dehydrogenase (ddh), wherein the variant enzyme exhibits dual specificity for coenzymes NADH and NADPH, resulting in decrease utilization of NADPH; and (3) expressing, in the host cell, a novel nicotinamide nucleotide transhydrogenase resulting in production of NADPH from NADH.

As shown in FIG. 1, the gapA enzyme uses NAD as a coenzyme to convert glyceraldehyde-3-phosphate to glycerate-1,3-bisphosphate. NAD is converted to NADH during this process. As further shown in FIG. 1, the glycolytic pathway feeds into the biosynthetic pathway leading to L-lysine production in bacteria. However, as discussed above, a critical factor in the biotechnological production of L-lysine with C. glutamicum is the sufficient supply of NADPH. As such, increasing NADPH production in C. glutamicum should lead to increased production of L-lysine.

One way of achieving this goal would be to alter the coenzyme specificity of the C. glutamicum gapA, such that the modified enzyme uses NADP as cofactor, as a result of which greater amounts of NADPH are generated in the cell. Thus, the aim of this experiment was to improve lysine productivity in C. glutamicum by broadening the coenzyme specificity of gapA to include NADP.

Previous studies have shown that D35G, L36T, T37K, and P192S mutations in the C. glutamicum gapA result in altered coenzyme specificity (from NAD to NADP) of the enzyme (Bomareddy R. R. et al. (2014), Metab. Eng., 25:30-37). We generated several strains of C. glutamicum, each expressing a gapA enzyme harboring one or more of the above mutations, as shown in Table 4 below.

Figure 2:
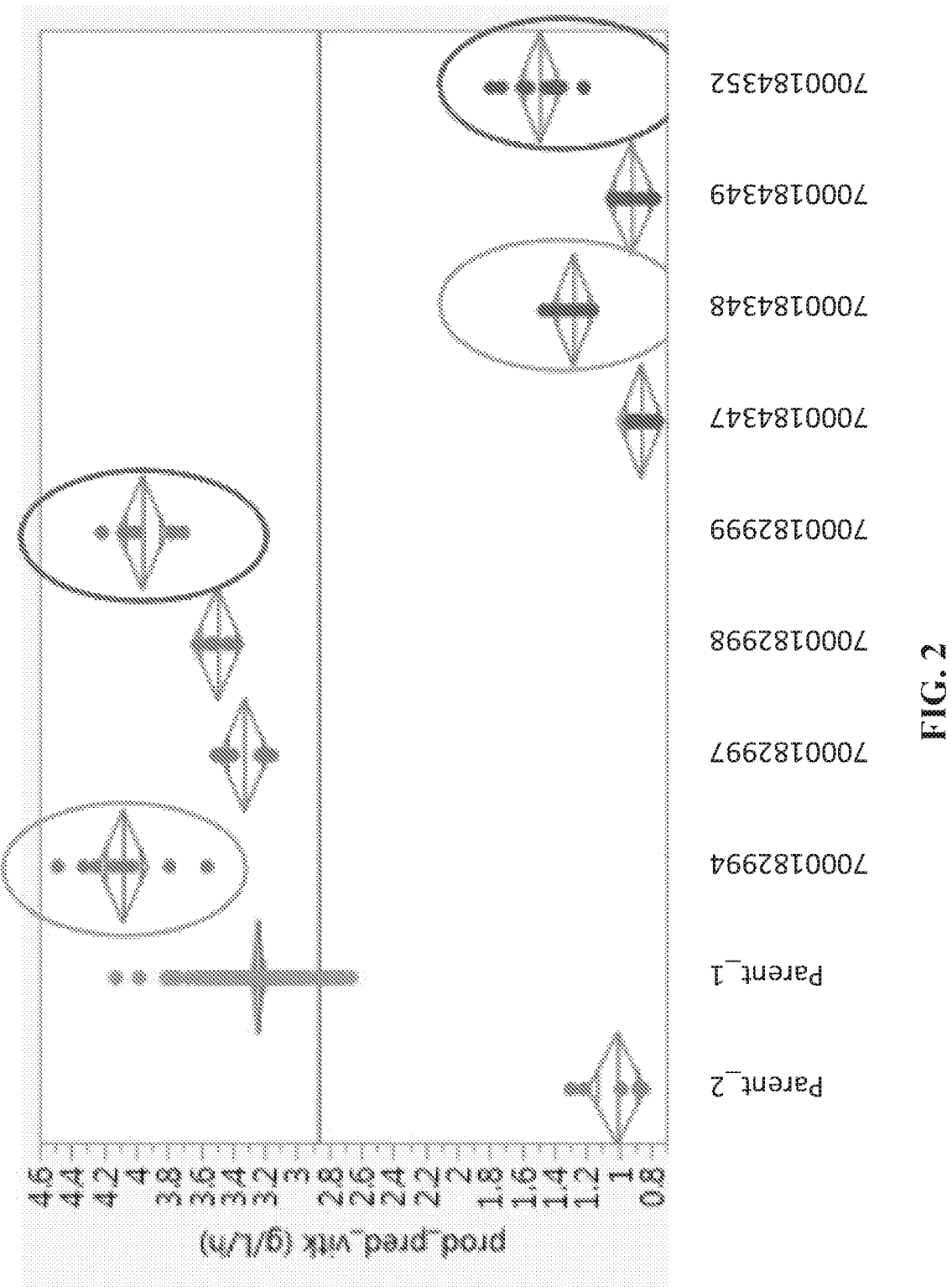
FIG. 2 shows L-lysine productivity in *Corynebacterium glutamicum* strains expressing modified Glyceraldehyde-3-phosphate dehydrogenase (GAPDH) as described in Example 1. Several strains of *C. glutamicum* were generated, each expressing a gapA enzyme harboring one or more of the following mutations: D35G, L36T, T37K, and P192S. The strains were then tested for their ability to produce L-lysine in comparison to the parent strain with the native gapA. The introduction of a GAPDH with certain mutations that confer altered coenzyme specificity to NADP significantly improved the productivity of L-lysine. T37K alone and T37K with L36T increase productivity significantly in 2 backgrounds. Strains 7000182994 and 7000184348 each contain T37K and perform better than their respective parents Parent 1 and Parent 2. Strains 7000182999 and 7000184352 each contain T37K and L36T and perform better than their respective parents Parent 1 and Parent 2.
Figure 3:
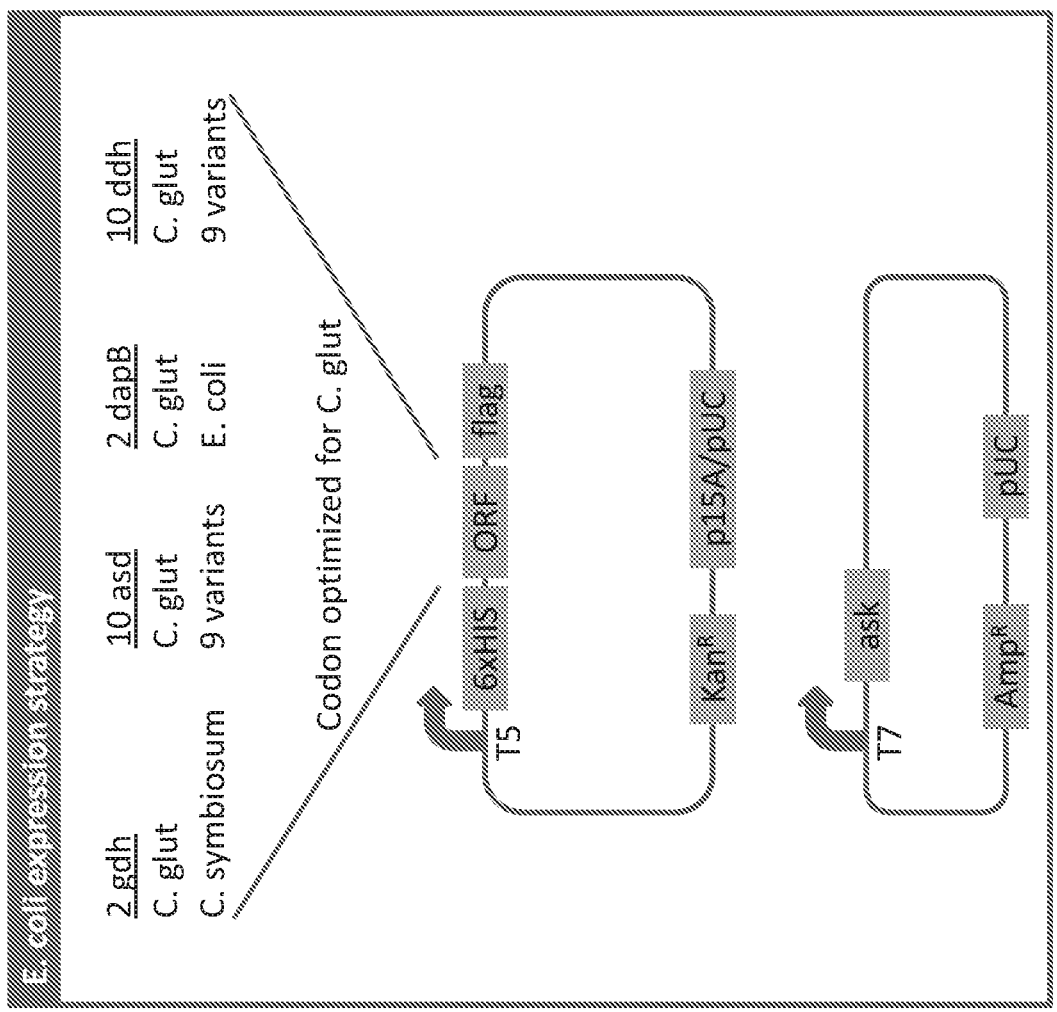
FIG. 3 illustrates the strategy for reprogramming the DAP-pathway for lysine synthesis in *C. glutamicum* by expressing variant gdh, asd, dapB and ddh enzymes, which use NADH more effectively than NADPH. *C. glutamicum* enzymes gdh and dapB have known homologues in *Clostridium symbiosum* and *Escherichia coli*, respectively that use NADH more effectively than NADPH. A genome-wide homology search in host cell was performed to find variants of *C. glutamicum* adh and ddh. The homology search yielded 9 variants for each enzyme. The known homologues of *C. glutamicum* gdh and dapB as well as the 9 variants of *C. glutamicum* asd and ddh were codon optimized and cloned into plasmids for expression in *C. glutamicum*.

The strains were tested for their ability to produce L-lysine in comparison to the reference strain with the native gapA. We found that the T37K mutation, either on its own or in combination with the L36T mutation, led to a broadening of the coenzyme specificity of the C. glutamicum gapA, such that the modified enzyme showed a preference towards both NAD and NADP, and the expression of the modified enzyme in C. glutamicum resulted in a significantly improved productivity of lysine (FIG. 2). The construction of the C. glutamicum gapA mutant strains (T37K and L36T/T37K) is described below.

The gapA gene was amplified by PCR using a chromosomal DNA of C. glutamicum (ATCC 13032) as a template using commercially sourced oligos. PCR fragments were assembled into Corynebacterium cloning vectors and mutagenized using standard site-directed mutagenesis techniques. Vectors were initially transformed into E. coli using standard heat shock transformation techniques in order to identify correctly assembled clones, and to amplify vector DNA for Corynebacterium transformation.

Validated clones were transformed into C. glutamicum host cells via electroporation. For each transformation, the number of Colony Forming Units (CFUs) per μg of DNA was determined as a function of the insert size. Corynebacterium genome integration was also analyzed as a function of homology arm length, and the results showed that shorter arms had a lower efficiency.

Cultures of Corynebacterium identified as having successful integrations of the insert cassette were cultured on kanamycin-containing media to counter select for loop outs of the kanamycin resistance selection gene.

In order to further validate loop out events, colonies exhibiting kanamycin resistance were cultured and analyzed via sequencing.

Several mutant strains were generated by the above process in two different lysine producing background strains Parent_2 and Parent_1. Table 4 describes the specific mutations introduced into each parent strain.

TABLE 4

| gapA Mutants. gapA Mutants | | |
|---|---|---|
| Mutation name | Mutation | Sequence change |
| gapAv1 | D35G | GTC→GCC |
| gapAv2 | L36T | GAG→GGT |
| gapAv3 | T37K | GGT→CTT |
| gapAv4 | P192S | AGG→GGA |

TABLE 4-continued

| gapA Mutants. gapA Mutants | | |
|---|---|---|
| Mutation name | Mutation | Sequence change |
| gapAv5 | D35G L36T | GAGGTC→GGTGCC |
| gapAv6 | D35G T37K | GGTGAGGTC→CTTGAGGCC |
| gapAv7 | L36T T37K | GGTGAG→CTTGGT |
| gapAv8 | D35G L36T T37K | GGTGAGGTC→CTTGGTGCC |
| gapAv9 | D35G L36T T37K P192S | GGTGAGGTC→CTTGGTGCC; CCT→AGC |

Each newly created strain and its parent strain was tested for lysine yield in small scale cultures (e.g., 96 well plates) designed to assess product titer performance. Small scale cultures were conducted using media from industrial scale cultures. Product titer was optically measured at carbon exhaustion (i.e., representative of single batch yield) with a standard colorimetric assay. Briefly, a concentrated assay mixture was prepared and was added to fermentation samples such that final concentrations of reagents were 160 mM sodium phosphate buffer, 0.2 mM Amplex Red, 0.2 U/mL Horseradish Peroxidase and 0.005 U/mL of lysine oxidase. Reactions were allowed to proceed to an end point and optical density measured using a Tecan M1000 plate spectrophotometer at a 560 nm wavelength. The results of the experiment are summarized in FIG. 2.

The introduction of a GAPDH with certain mutations that confer altered coenzyme specificity to NADP significantly improved the productivity of lysine (FIG. 2). Strains 7000182994 and 7000184348 each contain T37K and perform better than their respective parents Parent_1 and Parent_2. Strains 7000182999 and 7000184352 each contain T37K and L36T and perform better than their respective parents Parent_1 and Parent_2. Strains 7000182997 and 7000184349 each contain P192S. Strains 7000182998 and 7000184347 each contain L36T.

Example 2: Construction of a Threonine-Producing Base Strain of E. coli K-12 Strain, W3110

Like lysine (as well as methionine, isoleucine and glycine), the initial steps leading toward the threonine synthesis pathway involve conversion of oxaloacetate to aspartate, which uses glutamate that is regenerated from 2-oxoglutarate by the glutamate dehydrogenase enzyme (gdh). Aspartate is then converted to aspartyl phosphate, with subsequent reduction of aspartyl phosphate to aspartate semialdehyde (ASA) by the enzyme aspartate semialdehyde dehydrogenase (asd). These steps are common to lysine, threonine, isoleucine, and methionine biosynthesis. Threonine formation requires three additional steps beyond the asd conversion of aspartyl phosphate to ASA: (1) conversion of ASA to homoserine by bifunctional aspartokinase/homoserine dehydrogenase (thrA), (2) homoserine to L-homoserine phosphate by homoserine kinase (thrB) and, lastly, (3) conversion of L-homoserine phosphate to threonine by threonine synthase (thrC). These last three steps function independent of NADP/NADH We first generated threonine-producing base strains using a wild-type E. coli K-12 strain, W3110. This threonine base strain was created in two steps: First, we over-expressed the native, E. coli, thrLABC regulon (SEQ ID NO:76), consisting of: thrL (a leader sequence rich in threonine and isoleucine codons followed immediately by a functional transcriptional terminator that acts to prevent transcription of the enzyme-coding genes in the operon); thrA (bifunctional aspartokinase/homoserine dehydrogenase 1); thrB (homoserine kinase), and thrC (threonine synthase). This polynucleotide was amplified by PCR from W3110 genomic DNA using commercially-sourced oligonucleotides. The thrLABC operon was inserted into a multi-copy, replicating plasmid (modified pUC19 vector; SEQ ID NO:78) under control of a synthetic promoter pMB085 (FIG. 8A; SEQ ID NO:75). To alleviate attenuation of expression, a variant of this plasmid was constructed, in which the thrL leader sequence was removed (FIG. 8B; SEQ ID NO:77). Second, we deleted of a region of the E. coli W3110 chromosome encoding L-threonine 3-dehydrogenase (tdh), an enzyme that works in opposition to threonine production by catalyzing the oxidation of L-threonine to 2-amino-3-ketobutyrate.

To evaluate threonine production in the resulting W3110 threonine base strains W3110 pMB085thrLABCΔtdh (THR01; 7000336113) and W3110 pMB085thrABCΔtdh (THR02; 7000341282), each strain and its parent (W3110; 7000284155) was tested for threonine yield in small scale cultures (e.g., 96 well plates) designed to assess product titer performance. Small scale (300 ul) cultures were grown in TPM1 medium. TPM1 medium contains per liter: glucose, 50 g; yeast extract, 2 g; MgSO$_4$.7H$_2$O, 2 g; KH$_2$PO$_4$, 4 g; (NH$_4$)2SO$_4$, 14 g; betaine, 1 g; L-methionine, 0.149 g; L-lysine, 0.164 g; trace metal solution, 5 ml and CaCO$_3$, 30 g. The trace metal solution contains per liter: FeSO$_4$.7H$_2$O, 10 g; CaCl$_2$, 1.35 g; ZnSO$_4$.7H$_2$O, 2.25 g; MnSO$_4$.4H$_2$O, 0.5 g; CuSO$_4$.5H$_2$O, 1 g; (NH$_4$)$_6$Mo$_7$O$_{24}$.4H$_2$O, 0.106 g; Na$_2$B$_4$O$_7$.10H$_2$O, 0.23 g; 35% HCl, 10 ml. The final pH was adjusted to 7.2 by adding 4N KOH. Chloramphenicol (35 μg/ml), kanamycin (40 μg/ml) and ampicillin (50 μg/ml) were added to the medium when necessary. Cultures were grown for approximately 36 hours at 37 C in a humidified (80% humidity) INFORS HT Multitron Pro incubator shaker with constant agitation at 1000 rpm.

Threonine titer was determined in samples of cell-free media using the AccQ•Tag (Waters Corp.) precolumn derivatization and analysis technique for peptide and protein hydrolysate amino acids. Waters AccQ•Fluor Reagent was used to derivative the amino acids present in the samples. These derivatives were then separated by reverse-phase HPLC and quantitated by fluorescent detection. Biomass estimates were determined for each sample by measuring optical density (OD) using a Tecan M1000 plate spectrophotometer at a 660 nm wavelength, and final glucose concentration was determined by a standard colorimetric assay. Briefly, concentrated assay mixture was prepared with a final concentrations of reagents as follows: 175 mM sodium phosphate buffer, pH 7.0; 0.2 mM Amplex Red (Chemodex CDX-A0022); 16 U/mL glucose oxidase from *Aspergillus niger* (Sigma G7141) and 0.2 U/mL of Horseradish Peroxidase (VWR 0417-25000). Reactions were allowed to proceed in the dark for 30 minutes at room temperature and optical density was measured using a Tecan M1000 plate spectrophotometer at a 560 nm wavelength. The above culture conditions and measurements were used to calculate titer and to estimate yield and productivity of the strains described in the following examples.

Example 3: Broadening the Coenzyme Specificity of Glyceraldehyde 3-Phosphate Dehydrogenase (GAPDH)—Threonine The base strain described in Example 2 was used for the following example experiments.

Glyceraldehyde-3-phosphate dehydrogenase (GAPDH) is an enzyme involved in the central carbon metabolic pathway. The most common form of GAPDH is the NAD-dependent enzyme gapA, found in all organisms so far studied. This enzyme is encoded by the gapA gene, and converts glyceraldehyde-3-phosphate to glycerate-1,3-bisphosphate.

As shown in FIG. 9, the gapA enzyme uses NAD as a coenzyme to convert glyceraldehyde-3-phosphate to glycerate-1,3-bisphosphate. NAD is converted to NADH during this process. As further shown in FIG. 9 and FIG. 10A-C, the glycolytic pathway feeds into the biosynthetic pathway leading to L-threonine production in bacteria. However, as discussed above, a critical factor in the biotechnological production of L-threonine with E. coli is the sufficient supply of NADPH. As such, increasing NADPH production in E. coli should lead to increased production of L-threonine. One way of achieving this goal would be to alter the coenzyme specificity of gapA, such that the modified enzyme uses NADP as cofactor, as a result of which greater amounts of NADPH are generated in the cell. Thus, the aim of this experiment was to improve threonine productivity in E. coli by broadening the coenzyme specificity of gapA to include NADP.

Previous studies have shown that D35G, L36T, T37K, and P192S mutations in the C. glutamicum gapA result in altered coenzyme specificity (from NAD to NADP) of the enzyme (Bomareddy R.R. et al. (2014), Metab. Eng., 25:30-37). The amino acid sequence of the gapA enzyme from C. glutamicum is as follows:

```
                                          (SEQ ID NO: 58)
MTIRVGINGFGRIGRNFFRAILERSDDLEVVAVNDLTDNKTLSTLLKFDSI

MGRLGQEVEYDDDSITVGGKRIAVYAERDPKNLDWAAHNVDIVIESTGFFT

DANAAKAHIEAGAKKVIISAPASNEDATFVYGVNHESYDPENHNVISGASC

TTNCLAPMAKVLNDKFGIENGLMTTVHAYTGDQRLHDAPHRDLRRARAAAV

NIVPTSTGAAKAVALVLPELKGKLDGYALRVPVITGSATDLTFNTKSEVTV

ESINAAIKEAAVGEFGETLAYSEEPLVSTDIVHDSHGSIFDAGLTKVSGNT

VKVVSWYDNEWGYTCQLLRLTELVASKL.
```

Here, we generated several strains of E. coli, each expressing variants of the heterologous (C. glutamicum) gapA enzyme: gapAv5 (SEQ ID NO:69), gapAv7 (SEQ ID NO:71), or gapAv8 (SEQ ID NO:73) harboring one of the above mutations, as shown in Table 5 below.

TABLE 5

Mutant and native gapA variants tested in this study.

| | | gapA Enzymes | | |
|---|---|---|---|---|
| Gene | Source | Mutation(s) | Polynucleotide Seq. | Protein Seq. |
| gapA | E. coli | none (wild type) | SEQ ID NO: 68 | SEQ ID NO: 67 |
| gapAv5 | C. glutamicum | D35GL36T | SEQ ID NO: 70 | SEQ ID NO: 69 |

TABLE 5-continued

Mutant and native gapA variants tested in this study.
gapA Enzymes

| Gene | Source | Mutation(s) | Polynucleotide Seq. | Protein Seq. |
|---|---|---|---|---|
| gapAv7 | C. glutamicum | L36TT37K | SEQ ID NO: 72 | SEQ ID NO: 71 |
| gapAv8 | C. glutamicum | D35GL36TT37K | SEQ ID NO: 74 | SEQ ID NO: 73 |

The strains were tested for their ability to produce L-threonine relative to the reference strain (W3110thrABCΔtdh) with the native E. coli gapA (SEQ ID NO:67). We found that the expression of all three variants—gapAv5 (SEQ ID NO:69), gapAv7 (SEQ ID NO:71), and gapAv8 (SEQ ID NO:73)—independently resulted in a significantly improved threonine titer (FIG. 11A). The construction of the E. coli gapA mutant strains is described below.

The gapA variants (gapAv5 (SEQ ID NO:69), gapAv7 (SEQ ID NO:71), or gapAv8 (SEQ ID NO:73)) were amplified by PCR from Corynebacterium cloning vectors using commercially sourced oligos. Native E. coli gapA was amplified from W3110 genomic DNA. PCR fragments were assembled into E. coli cloning vectors—modified pUC19 vectors (coding polynucleotide sequences provided as SEQ ID NO: 70, 72, and 74) and initially transformed into NEB 10-beta E. coli cells using standard heat shock transformation techniques, in order to identify correctly assembled clones, and to amplify vector DNA for transformation into E. coli W3110 threonine base strains THR01 and THR02.

Each newly created strain and its parent strain was tested for threonine production in small scale cultures (e.g., 96 well plates) as described above.

The introduction of a GAPDH with certain mutations that confer altered coenzyme specificity to NADP significantly improved threonine titer (FIG. 11A). Strains 7000342726 (gapAv5), 7000342720 (gapAv7) and 7000342727 (gapAv8) all perform better than their parent strain (7000341282) and the parent expressing a second copy of E. coli gapA (7000342723).

TABLE 6

Threonine productivity of gapA variants

| Strain ID | | Titer | STDEV |
|---|---|---|---|
| 7000342726 | gapAv5 | 19.04 | 8.33 |
| 7000342720 | gapAv7 | 15.47 | 9.45 |
| 7000342727 | gapAv8 | 8.73 | 4.18 |
| 7000342723 | Ec_gapA | 0.79 | 1.37 |
| 7000341282 | thrABC | 0.79 | 1.37 |
| 7000284155 | W3110 | 0 | 0 |

Example 4: Reprogramming the DAP-Pathway for Lysine Synthesis by Utilizing Variant Enzymes with Cofactor Specificity for NADH The biosynthetic pathway leading to L-lysine production in bacteria is known as the diaminopimelate (DAP)-pathway (FIG. 1). The initial steps toward the DAP-pathway involve conversion of oxaloacetate to aspartate which uses glutamate that is regenerated from 2-oxoglutarate by the glutamate dehydrogenase enzyme (gdh). Aspartate is then converted to aspartyl phosphate, with subsequent reduction of aspartyl phosphate to aspartate semialdehyde (ASA) by the enzyme aspartate semialdehyde dehydrogenase (asd). These steps are common to lysine, threonine, isoleucine, and methionine biosynthesis. The first committed step towards lysine biosynthesis is the conversion of ASA to dihydropicolinate (DHDP), catalyzed by dihydropicolinate synthase. DHDP is then reduced to tetrahydropicolinate (THDPA) by dihydropicolinate reductase (dapB). Several bacteria, including Corynebacterium glutamicum, possess the enzyme meso-diaminopimelate dehydrogenase (ddh), which catalyzes the direct conversion of THDPA to meso-diaminopimelate (mDAP), which is then converted to L-lysine by diaminopimelate decarboxylase.

As shown in FIG. 1, each of the native C. glutamicum enzymes gdh, asd, dapB, and ddh require NADPH as coenzyme for their respective actions. However, NADPH is one of the limiting factors in the production of L-lysine from glucose in an industrial scale in C. glutamicum (Becker et al. (2005), Appl. Environ. Microbiol., 71(12):8587-8596). As such, increasing NADPH production in C. glutamicum should lead to increased production of L-lysine. One way of achieving this goal would be to decrease the utilization of NADPH by utilizing naturally-occurring homologues of the C. glutamicum enzymes gdh, asd, dapB, and ddh, which use NADH more effectively than NADPH as a cofactor. Thus, the aim of this experiment was to broaden the coenzyme dependencies of gdh, asd, dapB, and ddh to include NADH, along with NADPH.

C. glutamicum enzymes gdh and dapB have known homologues in Clostridium symbiosum (Lilley K. S. et al. (1991), Biochim Biophys Acta, 1080(3):191-197) and Escherichia coli (Reddy S. G. et al. (1995), Biochemistry, 34(11):3492-3501), respectively that use NADH more effectively than NADPH as a cofactor. No such homologues are known for C. glutamicum enzymes asd and ddh. As such, a genome-wide homology search in bacteria was performed to find amino acid sequence variants of the C. glutamicum enzymes, asd and ddh. The homology search yielded 9 variants each for asd and ddh. The sources of the variants and their sequences are summarized in Table 7. DNA sequences for gdh, asd, dapB and ddh are codon optimized to C. glutamicum.

TABLE 7

Sources and Sequences of Pathway Homologues
Pathway Homologues

| Species | Homologue | Code | Protein Sequence | DNA Sequence |
|---|---|---|---|---|
| A. oris | ddh | ddh_Aor | SEQ ID NO: 2 | SEQ ID NO: 1 |
| C. glutamicum | ddh | ddh_Cgl | SEQ ID NO: 4 | SEQ ID NO: 3 |
| H. archaeon | ddh | ddh_Har | SEQ ID NO: 6 | SEQ ID NO: 5 |
| coprobacillus | ddh | ddh_Cop | SEQ ID NO: 8 | SEQ ID NO: 7 |

TABLE 7-continued

Sources and Sequences of Pathway Homologues
Pathway Homologues

| Species | Homologue | Code | Protein Sequence | DNA Sequence |
|---|---|---|---|---|
| M. harundinacea | ddh | ddh_Mha | SEQ ID NO: 10 | SEQ ID NO: 9 |
| M. micronuciformis | ddh | ddh_Mmi | SEQ ID NO: 12 | SEQ ID NO: 11 |
| A. denitrificans | ddh | ddh_Ade | SEQ ID NO: 14 | SEQ ID NO: 13 |
| M. luteus | ddh | ddh_Mlu | SEQ ID NO: 16 | SEQ ID NO: 15 |
| B. faecium | ddh | ddh_Bfae | SEQ ID NO: 18 | SEQ ID NO: 17 |
| carnobacterium | ddh | ddh_Car | SEQ ID NO: 20 | SEQ ID NO: 19 |
| M. jannaschii | asd | asd_Mja | SEQ ID NO: 22 | SEQ ID NO: 21 |
| S. usitatus | asd | asd_Sus | SEQ ID NO: 24 | SEQ ID NO: 23 |
| N. innermongolicus | asd | asd_Nin | SEQ ID NO: 26 | SEQ ID NO: 25 |
| C. aurantiacus | asd | asd_Cau | SEQ ID NO: 28 | SEQ ID NO: 27 |
| L. agilis | asd | asd_Lag | SEQ ID NO: 30 | SEQ ID NO: 29 |
| B. pullorum | asd | asd_Bpu | SEQ ID NO: 32 | SEQ ID NO: 31 |
| B. bacterium | asd | asd_Bba | SEQ ID NO: 34 | SEQ ID NO: 33 |
| M. hansupus | asd | asd_Mha | SEQ ID NO: 36 | SEQ ID NO: 35 |
| P. sabinae | asd | asd_Psa | SEQ ID NO: 38 | SEQ ID NO: 37 |
| C. glutamicum | asd | asd_Cgl | SEQ ID NO: 40 | SEQ ID NO: 39 |
| C. glutamicum | gdh | gdh_Cgl | SEQ ID NO: 42 | SEQ ID NO: 41 |
| C. symbiosum | gdh | gdh_Csy | SEQ ID NO: 44 | SEQ ID NO: 43 |
| C. glutamicum | dapB | dapB_Cgl | SEQ ID NO: 46 | SEQ ID NO: 45 |
| E. coli | dapB | dapB_Eco | SEQ ID NO: 48 | SEQ ID NO: 47 |
| C. glutamicum | aspK | aspK10 | SEQ ID NO: 50 | SEQ ID NO: 49 |

Figure 4:
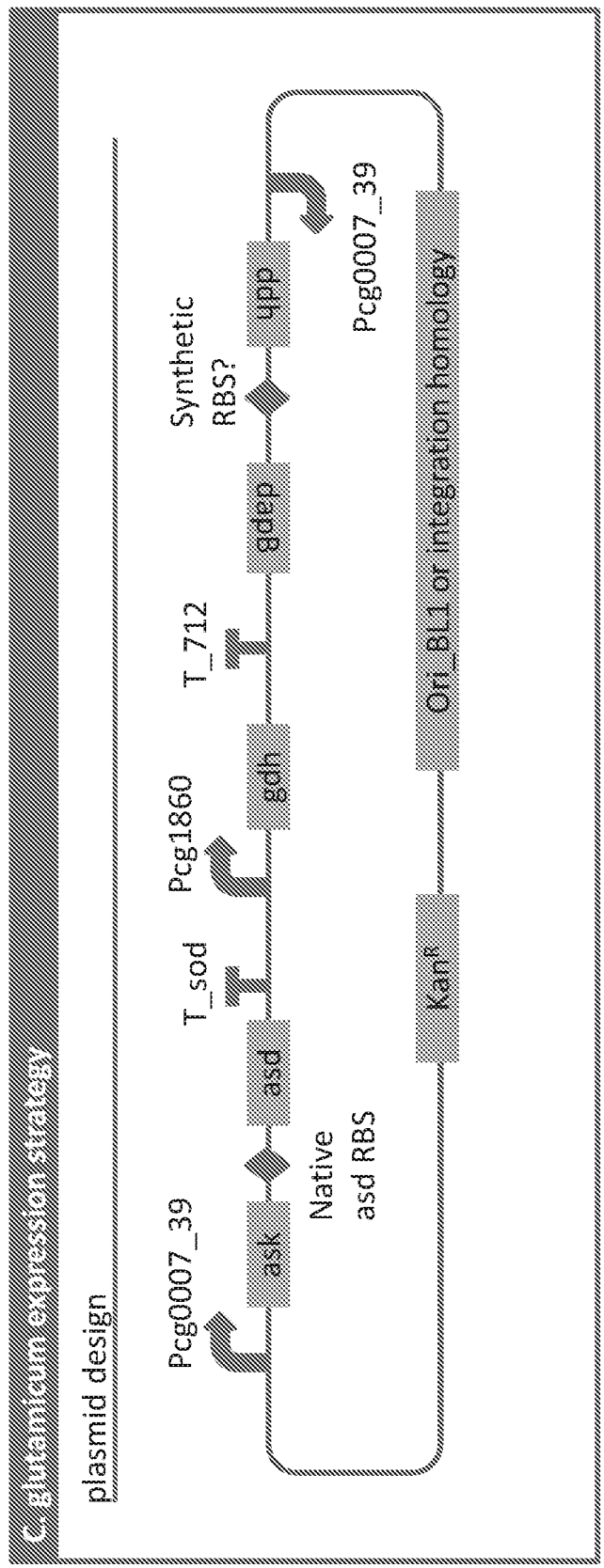
FIG. 4 illustrates the strategy for expressing various combinations of the variant gdh, asd, dapB and ddh enzymes in *C. glutamicum*. One copy of each of the different versions of the gdh, asd, dapB and ddh enzymes were cloned in various combinations into plasmids containing a kanamycin resistance marker gene. Each plasmid was then introduced into *C. glutamicum*, and the enzyme genes were integrated into the *C. glutamicum* chromosome by standard homologous recombinant techniques. Clones which successfully integrated the enzyme genes in their genomes were selected by cultivation on medium containing kanamycin. All four enzymes were simultaneously expressed in *C. glutamicum*.

The known homologues of C. glutamicum gdh and dapB as well as the 9 variants of C. glutamicum asd and ddh were codon optimized for expression in C. glutamicum. As shown in FIG. 4, one copy each of the two versions of gdh and dapB, and one copy each of the ten versions of asd and ddh were cloned in various combinations into a plasmid containing a kanamycin resistance marker gene. The combinations of enzymes that were tested in this Example are summarized in Table 7.

Each asd-gdh-dapB-ddh combination was cloned into a plasmid (SEQ ID NO: 51). FIG. 4 illustrates the cassette arrangement for one exemplary asd-gdh-dapB-ddh test combinations. Regulatory sequences were SEQ ID NOs: 52-57. The final cassette for each test combination can be represented from 5' to 3' end as follows:

```
Promoter sequences and insert location
SEQ ID NO: 52 <ASK gene sequence (SEQ ID NO: 304)>
SEQ ID NO: 53 <ASD gene sequence>
SEQ ID NO: 54 <GDH gene sequence> SEQ ID NO: 55
<reverse complement of DAPB gene sequence>
SEQ ID NO: 56 <reverse complement of DDH gene
sequence> SEQ ID NO: 57
TGCCGTTTCTCGCGTTGTGTGTGGTACTACGTGGGGACCTAAGCGTGTA

TTATGGAAACGTCTGTATCGGATAAGTAGCGAGGAGTGTTCGTTAAAA
```

-continued

```
<ASK gene sequence (SEQ ID NO: 304)> TAGAGTTTTAAA

GGAGTAGTTTTACA <ASD gene sequence> TAGGCATTTTTAGT

ACGTGCAATAACCACTCTGGTTTTTCCAGGGTGGTTTTTTGATGCCCTT

TTTGGAGTCTTCAACTGCTTAGCTTTGACCTGCACAAATAGTTGCAAAT

TGTCCCACATACACATAAAGTAGCTTGCGTATTTAAAATTATGAACCTA

AGGGGTTTAGCA <GDH gene sequence>

TAGGCTTTTCGACGTCTCCTCCGGCGAAACCCAAAAAAGGAACCCTCAC

AGTTCGTGAGGGTTCCTTTTACTATTGTCTA <reverse complement of DAPB gene sequence> TGTAAAACTACTCCTTTAAAACTCTA <reverse complement of DDH gene sequence> TTTTAACGA

ACACTCCTCGCTACTTATCCGATACAGACGTTTCCATAATACACGCTTAGG

TCCCCACGTAGTACCACACACAACGCGAGAAACGGCA
```

It is noted that the reverse complement orientation of the dapB and ddh alleles is a consequence of the expression cassette arrangement, and is not indicative of an intent to trigger silencing for said alleles.

TABLE 8

Combinations of Pathway Homologues.
Pathway Homologues
Plasmid combinations (individual plasmid are composed of the
backbone sequence of SEQ ID NO: 51 plus the combo
of genes inserted into their respective location amidst
overexpression promoters as specified above and shown in
FIG. 4. Genes are referenced by their gene codes as found
in Table 7. "RC" indicates reverse complement placement
of the gene according to FIG. 4.)

| asd allele | gdh allele | dapB allele | ddh allele |
|---|---|---|---|
| asd_Bpu (SEQ ID NO: 31) | gdh_Cgl (SEQ ID NO: 41) | RCdapB_Cgl (SEQ ID NO: 45) | RCddh_Cgl (SEQ ID NO: 3) |

TABLE 8-continued

Combinations of Pathway Homologues.
Pathway Homologues
Plasmid combinations (individual plasmid are composed of the backbone sequence of SEQ ID NO: 51 plus the combo of genes inserted into their respective location amidst overexpression promoters as specified above and shown in FIG. 4. Genes are referenced by their gene codes as found in Table 7. "RC" indicates reverse complement placement of the gene according to FIG. 4.)

| asd allele | gdh allele | dapB allele | ddh allele |
|---|---|---|---|
| asd_Bpu (SEQ ID NO: 31) | gdh_Csy (SEQ ID NO: 43) | RCdapB_eco (SEQ ID NO: 47) | RCddh_Cgl (SEQ ID NO: 3) |
| asd_Cau (SEQ ID NO: 27) | gdh_Csy (SEQ ID NO: 43) | RCdapB_eco (SEQ ID NO: 47) | RCddh_Cgl (SEQ ID NO: 3) |
| asd_Cgl (SEQ ID NO: 39) | gdh_Csy (SEQ ID NO: 43) | RCdapB_eco (SEQ ID NO: 47) | RCddh_Ade (SEQ ID NO: 13) |
| asd_Cgl (SEQ ID NO: 39) | gdh_Csy (SEQ ID NO: 43) | RCdapB_eco (SEQ ID NO: 47) | RCddh_Aor (SEQ ID NO: 1) |
| asd_Cgl (SEQ ID NO: 39) | gdh_Csy (SEQ ID NO: 43) | RCdapB_eco (SEQ ID NO: 47) | RCddh_Bfae (SEQ ID NO: 17) |
| asd_Cgl (SEQ ID NO: 39) | gdh_Csy (SEQ ID NO: 43) | RCdapB_eco (SEQ ID NO: 47) | RCddh_Car (SEQ ID NO: 19) |
| asd_Cgl (SEQ ID NO: 39) | gdh_Csy (SEQ ID NO: 43) | RCdapB_eco (SEQ ID NO: 47) | RCddh_Cgl (SEQ ID NO: 3) |
| asd_Cgl (SEQ ID NO: 39) | gdh_Csy (SEQ ID NO: 43) | RCdapB_eco (SEQ ID NO: 47) | RCddh_Cop (SEQ ID NO: 7) |
| asd_Cgl (SEQ ID NO: 39) | gdh_Csy (SEQ ID NO: 43) | RCdapB_eco (SEQ ID NO: 47) | RCddh_Har (SEQ ID NO: 5) |
| asd_Cgl (SEQ ID NO: 39) | gdh_Csy (SEQ ID NO: 43) | RCdapB_eco (SEQ ID NO: 47) | RCddh_Mha (SEQ ID NO: 9) |
| asd_Cgl (SEQ ID NO: 39) | gdh_Csy (SEQ ID NO: 43) | RCdapB_eco (SEQ ID NO: 47) | RCddh_Mlu (SEQ ID NO: 15) |
| asd_Cgl (SEQ ID NO: 39) | gdh_Csy (SEQ ID NO: 43) | RCdapB_eco (SEQ ID NO: 47) | RCddh_Mmi (SEQ ID NO: 11) |
| asd_Lag (SEQ ID NO: 29) | gdh_Csy (SEQ ID NO: 43) | RCdapB_eco (SEQ ID NO: 47) | RCddh_Cgl (SEQ ID NO: 3) |
| asd_Nin (SEQ ID NO: 25) | gdh_Cgl (SEQ ID NO: 41) | RCdapB_Cgl (SEQ ID NO: 45) | RCddh_Cgl (SEQ ID NO: 3) |
| asd_Nin (SEQ ID NO: 25) | gdh_Csy (SEQ ID NO: 43) | RCdapB_eco (SEQ ID NO: 47) | RCddh_Cgl (SEQ ID NO: 3) |
| asd_Psa (SEQ ID NO: 37) | gdh_Csy (SEQ ID NO: 43) | RCdapB_eco (SEQ ID NO: 47) | RCddh_Cgl (SEQ ID NO: 3) |
| asd_Sus (SEQ ID NO: 23) | gdh_Csy (SEQ ID NO: 43) | RCdapB_eco (SEQ ID NO: 47) | RCddh_Cgl (SEQ ID NO: 3) |

Each plasmid was initially transformed into *E. coli* using standard heat shock transformation techniques in order to identify correctly assembled clones, and to amplify vector DNA for *Corynebacterium* transformation.

Validated clones were transformed into *C. glutamicum* host cells via electroporation. For each transformation, the number of Colony Forming Units (CFUs) per µg of DNA was determined as a function of the insert size. *Corynebacterium* genome integration was also analyzed as a function of homology arm length, and the results showed that shorter arms had a lower efficiency.

Cultures of *Corynebacterium* identified as having successful integrations of the insert cassette were cultured on kanamycin-containing media to counter select for loop outs of the kanamycin resistance selection gene.

In order to further validate loop out events, colonies exhibiting kanamycin resistance were cultured and analyzed via sequencing.

All four enzymes were simultaneously expressed in *C. glutamicum*.

The recombinant strains containing the heterologous versions of each enzyme were made from 3 different parent strains, all of which are genetically distinct lysine producer strains. Each newly created strain and its parent strain was tested for lysine yield in small scale cultures (e.g., 96-well plates) designed to assess product titer performance. Small scale cultures were conducted using media from industrial scale cultures. Product titer was optically measured at carbon exhaustion (i.e., representative of single batch yield) with a standard colorimetric assay. Briefly, a concentrated assay mixture was prepared and was added to fermentation samples such that final concentrations of reagents were 160 mM sodium phosphate buffer, 0.2 mM Amplex Red, 0.2 U/mL Horseradish Peroxidase and 0.005 U/mL of lysine oxidase. Reactions were allowed to proceed to an end point and optical density measured using a Tecan M1000 plate spectrophotometer at a 560 nm wavelength. The results of the experiment are presented in Table 9 and summarized in FIG. 5A and FIG. 5B.

Figure 5A:
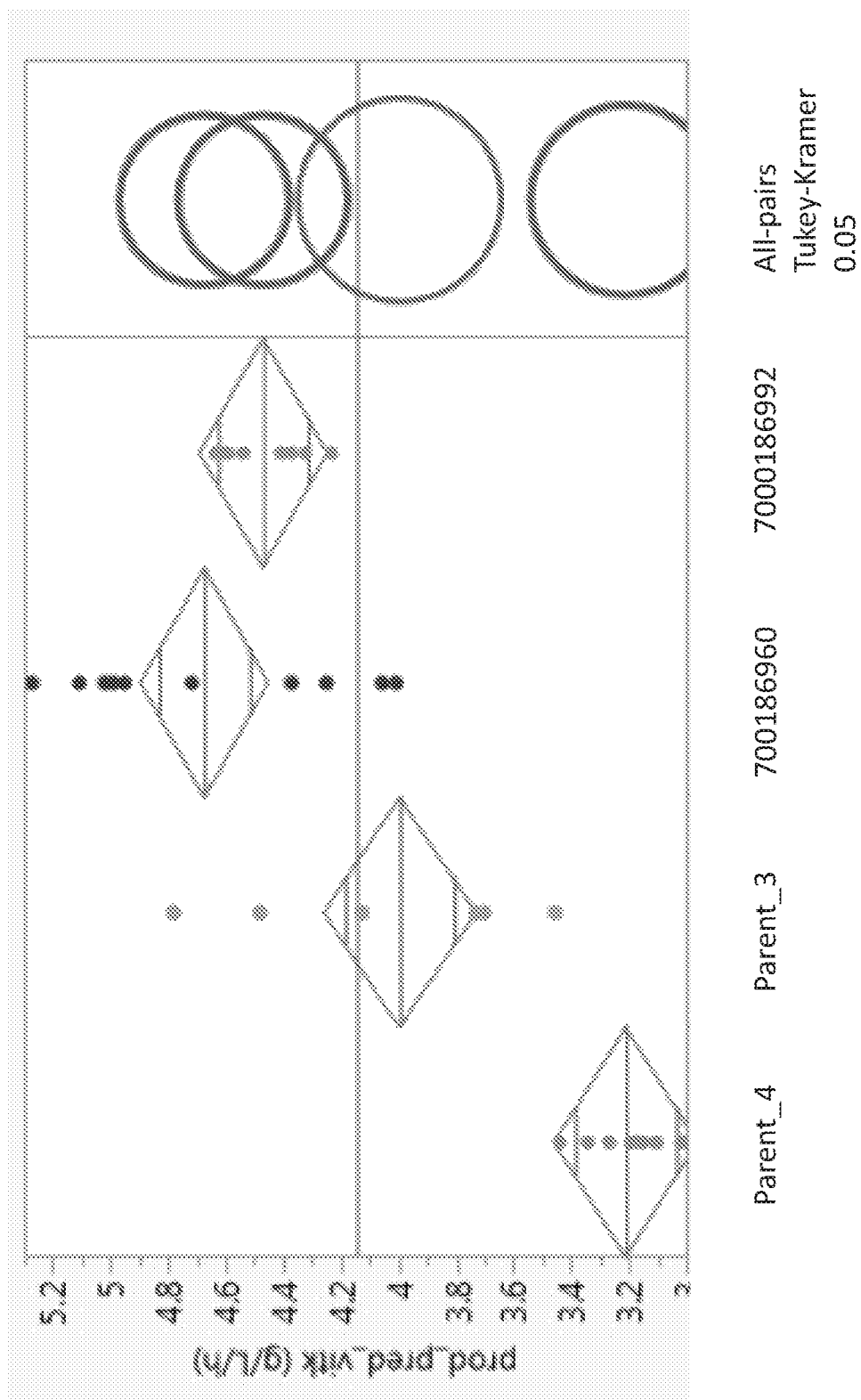
FIG. 5A-B show the effect of expression of various combinations of the different versions of the gdh, asd, dapB and ddh enzymes in *C. glutamicum*.
Figure 5B:
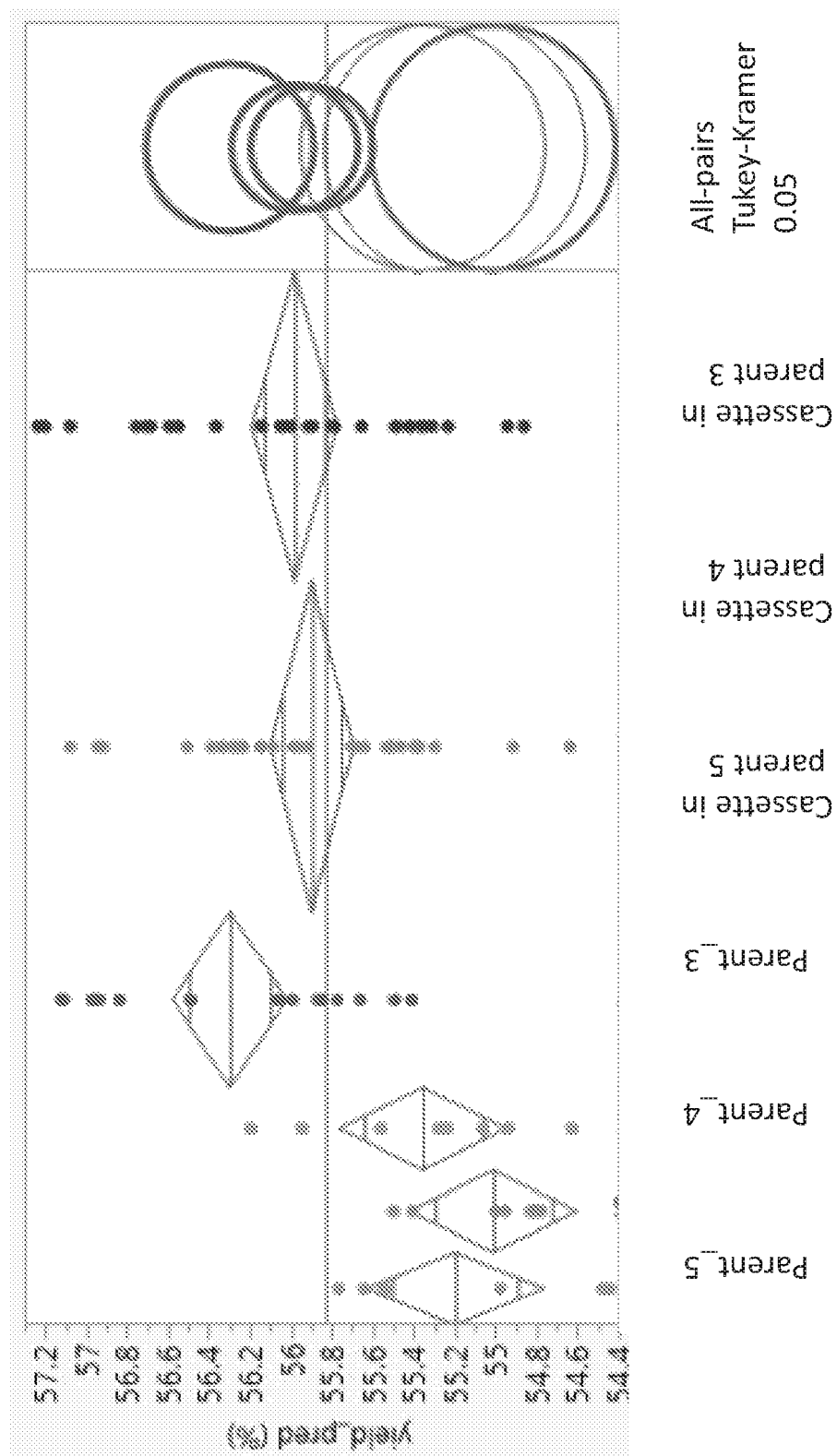

Two *C. glutamicum* recombinant strains, 7000186960 and 7000186992, each containing the native enzyme for *C. glutamicum* ddh and the same 3 heterologous enzymes for gdh, asd, and dapB (the known versions of *Clostridum symbiosum* gdh and *Escherichia coli* dapB that use the NADH, and a variant of asd from *Lactobacillus agilis*) showed a significantly improved productivity of L-lysine compared to their respective parents Parent_3 and Parent_4 (FIG. 5A). Data on the effect of the combinations of different enzymes is presented in Table 9, and enzyme combinations which lead to a significant improvement compared to the parent are highlighted in bold.

TABLE 9

Data for Homologue Combinations.
Data for Homoloque Combinations

| strain ZIDzid | parent_ strain_ | plasmid combination (combos with performance that is significantly different than parent are in bold) | Mean prod_ pred_ lys | Std Error prod_ pred_ lys | Lower 95% prod_ pred_ lys | Upper 95% prod_ pred_ lys | Mean yield_ pred | Std Error yield_ pred | Lower 95% yield_ pred | Upper 95% yield_ pred |
|---|---|---|---|---|---|---|---|---|---|---|
| Parent_5 | N/A | parent | 3.98959 | 0.10425 | 3.7796 | 4.1996 | 55.19853 | 0.24793 | 54.7072 | 55.6898 |
| 7000186924 | Parent_5 | asd_Cglgdh_CsyRCdapB_ecoRCddh_Mlu | 3.39671 | 0.10425 | 3.1867 | 3.6067 | 55.77395 | 0.23192 | 55.3144 | 56.2335 |
| 7000186925 | Parent_5 | asd_Cglgdh_CsyRCdapB_ecoRCddh_Aor | 3.46936 | 0.09324 | 3.2816 | 3.6572 | 56.28839 | 0.20744 | 55.8773 | 56.6994 |
| 7000186926 | Parent_5 | asd_Cglgdh_CsyRCdapB_ecoRCddh_Mha | 3.61019 | 0.09324 | 3.4224 | 3.798 | 55.70273 | 0.20744 | 55.2917 | 56.1138 |
| 7000186929 | Parent_5 | asd_Cglgdh_CsyRCdapB_ecoRCddh_Ade | 4.3899 | 0.12038 | 4.1475 | 4.6324 | 55.24996 | 0.23192 | 54.7904 | 55.7095 |
| 7000186930 | Parent_5 | asd_Bpugdh_CsyRCdapB_ecoRCddh_Cgl | 3.9191 | 0.10425 | 3.7091 | 4.1291 | 55.21564 | 0.20744 | 54.8046 | 55.6267 |
| 7000186935 | Parent_5 | asd_Ningdh_CglRCdapB_CglRCddh_Cgl | 3.08749 | 0.10425 | 2.8775 | 3.2975 | 55.85527 | 0.23192 | 55.3957 | 56.3148 |
| 7000186937 | Parent_5 | asd_Cglgdh_CsyRCdapB_ecoRCddh_Cop | 3.13201 | 0.12038 | 2.8896 | 3.3745 | 56.32266 | 0.20744 | 55.9116 | 56.7337 |
| 7000186940 | Parent_5 | asd_Cglgdh_CsyRCdapB_ecoRCddh_Cgl | 3.37994 | 0.10425 | 3.17 | 3.5899 | 56.52587 | 0.23192 | 56.0663 | 56.9854 |
| 7000186941 | Parent_5 | asd_Susgdh_CsyRCdapB_ecoRCddh_Cgl | 2.27348 | 0.09324 | 2.0857 | 2.4613 | 54.40485 | 0.20744 | 53.9938 | 54.8159 |
| 7000186943 | Parent_5 | asd_Cglgdh_CsyRCdapB_ecoRCddh_Car | 3.85216 | 0.10425 | 3.6422 | 4.0621 | 56.28212 | 0.23192 | 55.8226 | 56.7417 |
| 7000186945 | Parent_5 | asd_Cglgdh_CsyRCdapB_ecoRCddh_Mmi | 3.33 | 0.09324 | 3.1422 | 3.5178 | 55.76764 | 0.20744 | 55.3566 | 56.1787 |
| 7000186946 | Parent_5 | asd_Bpugdh_CglRCdapB_CglRCddh_Cgl | 3.86864 | 0.09324 | 3.6808 | 4.0564 | 55.55222 | 0.20744 | 55.1412 | 55.9633 |
| 7000186947 | Parent_5 | asd_Cglgdh_CsyRCdapB_ecoRCddh_Bfae | 3.58812 | 0.10425 | 3.3781 | 3.7981 | 56.31604 | 0.23192 | 55.8565 | 56.7756 |
| Parent_4 | N/A | parent | 3.21086 | 0.08147 | 3.0498 | 3.3719 | 55.01169 | 0.21589 | 54.585 | 55.4384 |
| 7000186980 | Parent_4 | asd_Psagdh_CsyRCdapB_ecoRCddh_Cgl | 4.14564 | 0.07287 | 4.0016 | 4.2897 | 55.71775 | 0.1931 | 55.3361 | 56.0994 |
| 7000186982 | Parent_4 | asd_Cglgdh_CsyRCdapB_ecoRCddh_Mmi | 2.73655 | 0.07287 | 2.5925 | 2.8806 | 55.96255 | 0.1931 | 55.5809 | 56.3442 |
| 7000186983 | Parent_4 | asd_Cglgdh_CsyRCdapB_ecoRCddh_Ade | 3.04197 | 0.07287 | 2.898 | 3.186 | 55.04775 | 0.20354 | 54.6454 | 55.4501 |

TABLE 9-continued

Data for Homologue Combinations.
Data for Homologue Combinations

| strain ZIDzid | parent_strain_id | plasmid combination (combos with performance that is significantly different than parent are in bold) | Mean prod_pred_lys | Std Error prod_pred_lys | Lower 95% prod_pred_lys | Upper 95% prod_pred_lys | Mean yield_pred | Std Error yield_pred | Lower 95% yield_pred | Upper 95% yield_pred |
|---|---|---|---|---|---|---|---|---|---|---|
| 7000186984 | Parent_4 | asd_Cglgdh_CsyRCdapB_ecoRCddh_Mha | 3.0087 | 0.07287 | 2.8647 | 3.1527 | 55.49415 | 0.1931 | 55.1125 | 55.8758 |
| 7000186990 | Parent_4 | asd_Cglgdh_CsyRCdapB_ecoRCddh_Har | 3.08588 | 0.06652 | 2.9544 | 3.2173 | 55.67801 | 0.18411 | 55.3141 | 56.0419 |
| 7000186992 | Parent_4 | asd_Laggdh_CsyRCdapB_ecoRCddh_Cgl | 4.47068 | 0.07287 | 4.3267 | 4.6147 | 55.76648 | 0.1931 | 55.3848 | 56.1482 |
| 7000186993 | Parent_4 | asd_Ningdh_CglRCdapB_CglRCddh_Cgl | 3.11677 | 0.07287 | 2.9728 | 3.2608 | 55.54902 | 0.1931 | 55.1674 | 55.9307 |
| 7000186994 | Parent_4 | asd_Caugdh_CsyRCdapB_ecoRCddh_Cgl | 3.05097 | 0.07287 | 2.907 | 3.195 | 55.34768 | 0.1931 | 54.966 | 55.7294 |
| 7000186995 | Parent_4 | asd_Cglgdh_CsyRCdapB_ecoRCddh_Cop | 3.06227 | 0.07287 | 2.9183 | 3.2063 | 55.73684 | 0.1931 | 55.3552 | 56.1185 |
| 7000186997 | Parent_4 | asd_Ningdh_CsyRCdapB_ecoRCddh_Cgl | 3.2248 | 0.07287 | 3.0808 | 3.3688 | 55.07264 | 0.1931 | 54.691 | 55.4543 |
| 7000186998 | Parent_4 | asd_Cglgdh_CsyRCdapB_ecoRCddh_Cgl | 3.14364 | 0.06652 | 3.0122 | 3.2751 | 56.02742 | 0.17627 | 55.679 | 56.3758 |
| 7000187001 | Parent_4 | asd_Cglgdh_CsyRCdapB_ecoRCddh_Car | 3.44828 | 0.07287 | 3.3043 | 3.5923 | 55.90289 | 0.1931 | 55.5212 | 56.2846 |
| 7000187003 | Parent_4 | asd_Cglgdh_CsyRCdapB_ecoRCddh_Mlu | 3.00001 | 0.07287 | 2.856 | 3.144 | 54.89024 | 0.1931 | 54.5086 | 55.2719 |
| 7000187004 | Parent_4 | asd_Bpugdh_CglRCdapB_CglRCddh_Cgl | 3.41613 | 0.07287 | 3.2721 | 3.5601 | 56.35596 | 0.1931 | 55.9743 | 56.7376 |
| 7000187005 | Parent_4 | asd_Cglgdh_CsyRCdapB_ecoRCddh_Bfae | 2.98817 | 0.07287 | 2.8442 | 3.1322 | 55.46868 | 0.1931 | 55.087 | 55.8504 |
| Parent_3 | N/A | parent | 3.99663 | 0.10864 | 3.7817 | 4.2115 | 55.35538 | 0.20109 | 54.9579 | 55.7529 |
| 7000186950 | Parent_3 | asd_Cglgdh_CsyRCdapB_ecoRCddh_Mha | 3.66355 | 0.0909 | 3.4838 | 3.8434 | 55.40642 | 0.17986 | 55.0509 | 55.762 |
| 7000186951 | Parent_3 | asd_Cglgdh_CsyRCdapB_ecoRCddh_Aor | 3.27925 | 0.08298 | 3.1151 | 3.4434 | 55.67602 | 0.17986 | 55.3205 | 56.0315 |
| 7000186952 | Parent_3 | asd_Cglgdh_CsyRCdapB_ecoRCddh_Mmi | 3.44824 | 0.0909 | 3.2684 | 3.628 | 55.65879 | 0.17986 | 55.3033 | 56.0143 |
| 7000186955 | Parent_3 | asd_Cglgdh_CsyRCdapB_ecoRCddh_Ade | 3.58453 | 0.0909 | 3.4047 | 3.7643 | 55.80398 | 0.17986 | 55.4485 | 56.1595 |
| 7000186958 | Parent_3 | asd_Cglgdh_CsyRCdapB_ecoRCddh_Har | 3.31468 | 0.0909 | 3.1349 | 3.4945 | 55.38588 | 0.17986 | 55.0304 | 55.7414 |
| 7000186960 | Parent_3 | asd_Laggdh_CsyRCdapB_ecoRCddh_Cgl | 4.67526 | 0.0909 | 4.4955 | 4.8551 | 55.26038 | 0.17986 | 54.9049 | 55.6159 |
| 7000186961 | Parent_3 | asd_Ningdh_CglRCdapB_CglRCddh_Cgl | 3.93776 | 0.0909 | 3.758 | 4.1176 | 55.35629 | 0.17986 | 55.0008 | 55.7118 |
| 7000186962 | Parent_3 | asd_Caugdh_CsyRCdapB_ecoRCddh_Cgl | 3.4915 | 0.08298 | 3.3274 | 3.6556 | 55.3 | 0.17149 | 54.961 | 55.639 |
| 7000186963 | Parent_3 | asd_Cglgdh_CsyRCdapB_ecoRCddh_Cgl | 3.34698 | 0.0909 | 3.1672 | 3.5268 | 56.16317 | 0.17986 | 55.8076 | 56.5187 |
| 7000186965 | Parent_3 | asd_Ningdh_CsyRCdapB_ecoRCddh_Cgl | 3.63562 | 0.10864 | 3.4207 | 3.8505 | 54.98718 | 0.17986 | 54.6317 | 55.3427 |

TABLE 9-continued

Data for Homologue Combinations.
Data for Homologue Combinations

| strain ZIDzid | parent_ strain_ ZIDzid | plasmid combination (combos with performance that is significantly different than parent are in bold) | Mean prod_ lys | Std Error prod_ lys | Lower 95% prod_ lys | Upper 95% prod_ lys | Mean yield_ pred | Std Error yield_ pred | Lower 95% yield_ pred | Upper 95% yield_ pred |
|---|---|---|---|---|---|---|---|---|---|---|
| 7000186966 | Parent_3 | asd_Cglgdh_CsyRCda pB_ecoRCddh_Cop | 3.17575 | 0.11734 | 2.9436 | 3.4079 | 55.9921 | 0.17986 | 55.6366 | 56.3476 |
| 7000186969 | Parent_3 | asd_Cglgdh_CsyRCda pB_ecoRCddh_Car | 3.42914 | 0.0909 | 3.2493 | 3.6089 | 55.79205 | 0.17986 | 55.4365 | 56.1476 |
| 7000186971 | Parent_3 | asd_Cglgdh_CsyRCda pB_ecoRCddh_Mlu | 3.59553 | 0.0909 | 3.4157 | 3.7753 | 55.0482 | 0.17986 | 54.6927 | 55.4037 |
| 7000186972 | Parent_3 | asd_Bpugdh_CglRCda pB_Cg1RCddh_Cg1 | 3.88679 | 0.10162 | 3.6858 | 4.0878 | 55.59951 | 0.17986 | 55.244 | 55.955 |
| 7000186973 | Parent_3 | asd_Cglgdh_CsyRCda pB_ecoRCddh_Bfae | 4.46987 | 0.11734 | 4.2377 | 4.702 | 55.46628 | 0.17986 | 55.1108 | 55.8218 |

Two versions of a 4-gene cassette were introduced into *Corynebacterium glutamicum* Parent_6 and production of lysine was monitored. The 4 genes were selected based on their use of alternative cofactor NADH, rather than NADPH. The 4-gene cassette v1 (strain 263254) contains aspartate-semi-aldehyde dehydrogenase (asd) from *C. glutamicum* (SEQ ID NO:39), glutamate dehydrogenase (gdh) from *Clostridium symbiosum* (SEQ ID NO: 43), 4-hydroxy-tetrahydrodipicolinate reductase (dapB) from *Escherichia coli* (SEQ ID NO: 47), and Meso-diaminopimelate D-dehydrogenase (ddh) from *C. glutamicum* (SEQ ID NO: 3). The 4-gene cassette v1 (strain 263254) therefore encodes aspartate-semi-aldehyde dehydrogenase (asd) from *C. glutamicum* (SEQ ID NO:40), glutamate dehydrogenase (gdh) from *Clostridium symbiosum* (SEQ ID NO: 44), 4-hydroxy-tetrahydrodipicolinate reductase (dapB) from *Escherichia coli* (SEQ ID NO: 48), and Meso-diaminopimelate D-dehydrogenase (ddh) from *C. glutamicum* (SEQ ID NO: 4).

4-gene cassette v2 (strain 263264) contains aspartate-semi-aldehyde dehydrogenase (asd) from *Lactobacillus agilis* (SEQ ID NO: 29), glutamate dehydrogenase (gdh) from *Clostridium symbiosum* (SEQ ID NO: 43), 4-hydroxy-tetrahydrodipicolinate reductase (dapB) from *Escherichia coli* (SEQ ID NO: 47), and Meso-diaminopimelate D-dehydrogenase (ddh) from *C. glutamicum* (SEQ ID NO: 3). 4-gene cassette v2 (strain 263264) therefore encodes aspartate-semi-aldehyde dehydrogenase (asd) from *Lactobacillus agilis* (SEQ ID NO: 30), glutamate dehydrogenase (gdh) from *Clostridium symbiosum* (SEQ ID NO: 44), 4-hydroxy-tetrahydrodipicolinate reductase (dapB) from *Escherichia coli* (SEQ ID NO: 48), and Meso-diaminopimelate D-dehydrogenase (ddh) from *C. glutamicum* (SEQ ID NO: 4).

The 4-gene cassettes significantly improved lysine production in plate model 9. The data are summarized in Table 10.

TABLE 10

Improved Lysine Production

| Gene Casette | Strain | Titer mM (95% CI) | % improvement over patent |
|---|---|---|---|
| None | Parent_6 | 6.45 +/− 0.9 | n/a |
| Cassette v1 | 263254 | 12.41 +/− 0.9 | 92.4 |
| Cassette v2 | 263264 | 9.33 +/− 1.1 | 44.7 |

Example 5: Reprogramming the Threonine Biosynthesis Pathway by Utilizing Variant Enzymes with Cofactor Specificity for NADH The base strain described in Example 2 was used for the following example experiments.

The biosynthetic pathway leading to L-threonine production in bacteria is known as the thrABC pathway (FIG. 9). Like lysine (and methionine, isoleucine and glycine) the initial steps leading toward the threonine synthesis pathway involve conversion of oxaloacetate to aspartate, which uses glutamate that is regenerated from 2-oxoglutarate by the glutamate dehydrogenase enzyme (gdh). Aspartate is then converted to aspartyl phosphate, with subsequent reduction of aspartyl phosphate to aspartate semialdehyde (ASA) by the enzyme aspartate semialdehyde dehydrogenase (asd). These steps are common to lysine, threonine, isoleucine, and methionine biosynthesis. Threonine formation requires three additional steps beyond the asd conversion of aspartyl phosphate to ASA—conversion of ASA to homoserine by bifunctional aspartokinase/homoserine dehydrogenase (thrA), homoserine to L-homoserine phosphate by homoserine kinase (thrB) and, lastly, conversion of L-homoserine phosphate to threonine by threonine synthase (thrC)—but these last three steps function independent of NADP/NADH and any potential bottleneck in this pathway is de-risked in the threonine base strains by overexpression of the thrABC operon.

As shown in FIG. 9, each of the native *E. coli* enzymes gdh and asd require NADPH as coenzyme for their respective actions. However, NADPH is one of the limiting factors in the production of L-threonine from glucose in an industrial scale in *E. coli* (Becker et al. (2005), *Appl. Environ. Microbiol.*, 71(12): 8587-8596). As such, increasing NADPH production in *E. coli* should lead to increased production of L-threonine. One way of achieving this goal would be to decrease the utilization of NADPH by utilizing naturally-occurring homologues of the *E. coli* enzymes gdh, and asd, which use NADH more effectively than NADPH as a cofactor. Thus, the aim of this experiment was to broaden the coenzyme dependencies of gdh and asd to include NADH, along with NADPH.

The *E. coli* enzymes gdh has a known homolog in *Clostridium symbiosum* (Lilley K. S. et al. (1991), *Biochim Biophys Acta*, 1080(3):191-197) that uses NADH more effectively than NADPH as a cofactor. No such homologues are known for *E. coli* asd. To investigate whether we could identify additional gdh homologs with stronger NADH preference and novel homologs of asd possessing NADH preference, we performed a genome-wide homology search of an in-house metagenomics library developed from environmental samples. The search consisted of a BlastP analysis of said library using the protein sequences of *Lactobacillus agilis* asd (asd lag; SEQ ID 30) and *Clostridiales* gdh (gdh_csy; SEQ ID: 44). The homology search retrieved hundreds of sequences, but further filtering and selection criteria were applied to arrive at libraries of twenty-four sequences for each enzyme. Approximately twelve sequences for each enzyme were selected from a filtered subset of results with <70% identity to the query sequence. Approximately another twelve sequences were selected from a subset of sequences with >70% identity to the query sequences.

TABLE 11

Summary and polynucleotide sequences of parts used in the construction of the multicopy threonine operon expression vectors used to create the threonine base strains.

| Part Type | Part Name | SEQ ID |
| --- | --- | --- |
| Promoter | pMB085 | 75 |
| Insert (genes) | thrLABC | 76 |
| Insert (genes) | thrABC | 77 |
| Backbone | pUC19 vector | 78 |

TABLE 12

Sources and Sequences of Pathway Homologues. Enzyme Homologue Libraries

| Species | E. coli gene | Gene ID | Protein sequence | DNA sequence |
| --- | --- | --- | --- | --- |
| *Lactobacillus agilis* | asd | asd_Lag | SEQ ID NO: 80 | SEQ ID NO: 79 |
| *E. coli* | asd | asd_Ec | SEQ ID NO: 82 | SEQ ID NO: 81 |
| unknown | asd | asd_1 | SEQ ID NO: 84 | SEQ ID NO: 83 |
| unknown | asd | asd_2 | SEQ ID NO: 86 | SEQ ID NO: 85 |
| unknown | asd | asd_3 | SEQ ID NO: 88 | SEQ ID NO: 87 |
| unknown | asd | asd_4 | SEQ ID NO: 90 | SEQ ID NO: 89 |
| unknown | asd | asd_5 | SEQ ID NO: 92 | SEQ ID NO: 91 |
| unknown | asd | asd_6 | SEQ ID NO: 94 | SEQ ID NO: 93 |
| unknown | asd | asd_7 | SEQ ID NO: 96 | SEQ ID NO: 95 |
| unknown | asd | asd_8 | SEQ ID NO: 98 | SEQ ID NO: 97 |
| unknown | asd | asd_9 | SEQ ID NO: 100 | SEQ ID NO: 99 |
| unknown | asd | asd_10 | SEQ ID NO: 102 | SEQ ID NO: 101 |
| unknown | asd | asd_11 | SEQ ID NO: 104 | SEQ ID NO: 103 |
| unknown | asd | asd_12 | SEQ ID NO: 106 | SEQ ID NO: 105 |

TABLE 12-continued

Sources and Sequences of Pathway Homologues. Enzyme Homologue Libraries

| Species | E. coli gene | Gene ID | Protein sequence | DNA sequence |
| --- | --- | --- | --- | --- |
| unknown | asd | asd_13 | SEQ ID NO: 108 | SEQ ID NO: 107 |
| unknown | asd | asd_14 | SEQ ID NO: 110 | SEQ ID NO: 109 |
| unknown | asd | asd_15 | SEQ ID NO: 112 | SEQ ID NO: 111 |
| unknown | asd | asd_16 | SEQ ID NO: 114 | SEQ ID NO: 113 |
| unknown | asd | asd_17 | SEQ ID NO: 116 | SEQ ID NO: 115 |
| unknown | asd | asd_18 | SEQ ID NO: 118 | SEQ ID NO: 117 |
| unknown | asd | asd_19 | SEQ ID NO: 120 | SEQ ID NO: 119 |
| unknown | asd | asd_20 | SEQ ID NO: 122 | SEQ ID NO: 121 |
| unknown | asd | asd_21 | SEQ ID NO: 124 | SEQ ID NO: 123 |
| unknown | asd | asd_22 | SEQ ID NO: 126 | SEQ ID NO: 125 |
| unknown | asd | asd_23 | SEQ ID NO: 128 | SEQ ID NO: 127 |
| unknown | asd | asd_24 | SEQ ID NO: 130 | SEQ ID NO: 129 |
| Clostridiales | gdh | gdh_Csy | SEQ ID NO: 132 | SEQ ID NO: 131 |
| *E. coli* | gdh | gdh_Ec | SEQ ID NO: 134 | SEQ ID NO: 133 |
| unknown | gdh | gdh_1 | SEQ ID NO: 136 | SEQ ID NO: 135 |
| unknown | gdh | gdh_2 | SEQ ID NO: 138 | SEQ ID NO: 137 |
| unknown | gdh | gdh_3 | SEQ ID NO: 140 | SEQ ID NO: 139 |
| unknown | gdh | gdh_4 | SEQ ID NO: 142 | SEQ ID NO: 141 |
| unknown | gdh | gdh_5 | SEQ ID NO: 144 | SEQ ID NO: 143 |
| unknown | gdh | gdh_6 | SEQ ID NO: 146 | SEQ ID NO: 145 |
| unknown | gdh | gdh_7 | SEQ ID NO: 148 | SEQ ID NO: 147 |
| unknown | gdh | gdh_8 | SEQ ID NO: 150 | SEQ ID NO: 149 |
| unknown | gdh | gdh_9 | SEQ ID NO: 152 | SEQ ID NO: 151 |
| unknown | gdh | gdh_10 | SEQ ID NO: 154 | SEQ ID NO: 153 |
| unknown | gdh | gdh_11 | SEQ ID NO: 156 | SEQ ID NO: 155 |
| unknown | gdh | gdh_12 | SEQ ID NO: 158 | SEQ ID NO: 157 |
| unknown | gdh | gdh_13 | SEQ ID NO: 160 | SEQ ID NO: 159 |
| unknown | gdh | gdh_14 | SEQ ID NO: 162 | SEQ ID NO: 161 |
| unknown | gdh | gdh_15 | SEQ ID NO: 164 | SEQ ID NO: 163 |
| unknown | gdh | gdh_16 | SEQ ID NO: 166 | SEQ ID NO: 165 |
| unknown | gdh | gdh_17 | SEQ ID NO: 168 | SEQ ID NO: 167 |
| unknown | gdh | gdh_18 | SEQ ID NO: 170 | SEQ ID NO: 169 |
| unknown | gdh | gdh_19 | SEQ ID NO: 172 | SEQ ID NO: 171 |
| unknown | gdh | gdh_20 | SEQ ID NO: 174 | SEQ ID NO: 173 |
| unknown | gdh | gdh_21 | SEQ ID NO: 176 | SEQ ID NO: 175 |
| unknown | gdh | gdh_22 | SEQ ID NO: 178 | SEQ ID NO: 177 |
| unknown | gdh | gdh_23 | SEQ ID NO: 180 | SEQ ID NO: 179 |
| unknown | gdh | gdh_24 | SEQ ID NO: 182 | SEQ ID NO: 181 |

The open reading frames (ORFs) of known homologues of *E. coli* gdh (*Clostridiales* gdh; SEQ ID NO: 134) the *Lactobacillus agilis* asd (SEQ ID NO ID: 80) as well as the 24 variants of enzyme amplified by PCR using commercially sourced oligos and cloned into a multi-copy plasmid p15A based sequence (SEQ ID NO:239) containing regulatory sequences, promoter pMB038 (SEQ ID NO:237) and a transcription terminator (SEQ ID NO: 238) as shown in FIG. 12. One copy each of versions 26 of asd and versions 26 of gdh were cloned as bi-cistronic cassettes in various combinations into a multi-copy plasmid backbone based on p15A (SEQ ID NO: 239).

Each plasmid was initially transformed into *E. coli* using standard heat shock transformation techniques in order to identify correctly assembled clones, and to amplify vector DNA for transformation of threonine base strains (THR01-02).

Validated clones were transformed into *E. coli* base strain cells via electroporation. Each newly created strain and its parent strain was tested for threonine yield in small scale cultures as described above. The results of the experiment are presented in Table 13. Alleles asd 13 (SEQ ID NO: 108) and asd_18 (SEQ ID NO: 118) performed better, but not significantly different than controls. Alleles gdh_1 (SEQ ID NO: 136), ghd_8 (SEQ ID NO: 150), gdh_14 (SEQ ID NO: 162), gdh_16 (SEQ ID NO: 166), gdh_18 (SEQ ID NO: 170) gdh_20 (SEQ ID NO: 174) and gdh_22 (SEQ ID NO: 178)

each increased threonine compared to W3110 and the control strain (FIG. 13). Not all strains were successfully built and tested. Replicate samples that displayed poor/no growth and statistical outliers are not shown in FIG. 13, but are represented in Table 13.

TABLE 13

Summary of titer of strains overexpressing of asd and gdh variants.

| Strain # | ID | Titer | STDEV |
|---|---|---|---|
| 7000340960 | asd_1 | 0.00 | 0.00 |
| 7000340968 | asd_4 | 0.00 | 0.00 |
| 7000340961 | asd_5 | 0.00 | 0.00 |
| 7000340977 | asd_6 | 0.79 | 1.37 |
| 7000340972 | asd_8 | 0.00 | 0.00 |
| 7000340950 | asd_9 | 0.00 | 0.00 |
| 7000340979 | asd_10 | 0.00 | 0.00 |
| 7000340945 | asd_11 | 0.00 | 0.00 |
| 7000340949 | asd_12 | 0.00 | 0.00 |
| 7000340981 | asd_13 | 7.14 | 3.57 |
| 7000340980 | asd_14 | 0.00 | 0.00 |
| 7000340955 | asd_15 | 0.00 | 0.00 |
| 7000340940 | asd_16 | 0.00 | 0.00 |
| 7000340967 | asd_17 | 0.00 | 0.00 |
| 7000340970 | asd_18 | 7.54 | 2.48 |
| 7000340975 | asd_20 | 0.00 | 0.00 |
| 7000340978 | asd_22 | 0.00 | 0.00 |
| 7000340987 | gdh_1 | 28.96 | 5.37 |
| 7000340951 | gdh_3 | 0.00 | 0.00 |
| 7000340958 | gdh_4 | 0.00 | 0.00 |
| 7000340959 | gdh_5 | 1.59 | 2.75 |
| 7000340941 | gdh_6 | 0.00 | 0.00 |
| 7000340957 | gdh_7 | 0.00 | 0.00 |
| 7000340962 | gdh_8 | 6.74 | 8.77 |
| 7000340952 | gdh_14 | 14.28 | 2.06 |
| 7000340948 | gdh_16 | 8.73 | 15.12 |
| 7000340966 | gdh_18 | 10.31 | 9.24 |
| 7000340983 | gdh_19 | 0.00 | 0.00 |
| 7000340971 | gdh_20 | 11.50 | 6.77 |
| 7000340936 | gdh_21 | 0.00 | 0.00 |
| 7000340939 | gdh_22 | 3.97 | 6.87 |
| 7000340964 | gdh_23 | 0.00 | 0.00 |
| 7000340944 | gdh_24 | 0.00 | 0.00 |
| 7000347664 | thrABC p15A control | 2.38 | 2.26 |
| 7000284155 | W3110 | 0.00 | 0.00 |

Example 6: Improving Threonine Titer by Utilizing Variant Threonine Aldolase Enzymes with Different Substrate Preferences and Enzyme Kinetics The base strain described in Example 2 was used for the following example experiments.

This Example demonstrates a method to increase L-threonine production in bacterial host cells using heterologous threonine aldolase genes. In $E.$ $coli$, threonine aldolase (ltaE) works in opposition to the accumulation of threonine by converting L-threonine to acetaldehyde and glycine. However, diverse substrate specificity and enzyme kinetics exist within the broader taxonomic family of threonine aldolase enzymes (TAs). This Example illustrates a strategy to exploit the diverse substrate preference found among TAs to improve the yield of threonine, by allowing one to add, or replace native ltaE gene with, a heterologous TA possessing different substrate preference or enzyme kinetics. However, it should be noted that this Example, like the embodiments described above, are illustrative and are not to be construed as restricting the scope of the disclosure in any way.

Aldolases catalyze the reversible aldol addition of a donor component (nucleophile) to an acceptor component. $E.$ $coli$ threonine aldolase (ltaE) catalyzes the cleavage of L-allo-threonine and L-threonine to glycine and acetaldehyde (FIG. 10A). In $E.$ $coli$, ltaE works in opposition to threonine accumulation by converting the L-threonine to glycine. However, diverse substrate specificity exists within the broader taxonomic family of threonine aldolase genes (TAs). TAs with substrate preferences (e.g., serine, alanine) and kinetics favorable for the formation of L-threonine have been described (Fesko et al., 2015).

To investigate whether we could identify homologs of $E.$ $coli$ ltaE with substrate preference or enzyme kinetics that favor threonine production, we performed a genome-wide homology search of an in-house metagenomics library developed from environmental samples. The search consisted of a BlastP analysis of said library using the protein sequence from $Cronobacter$ $sakazakaii$ threonine aldolase (Csa_ltaE; SEQ ID NO: 183) an enzyme with reported preference for glycine (Fesko et al., 2015). The ltaE search retrieved hundreds of sequences, but further filtering and selection criteria were applied to arrive at a library of twenty-four sequences. Approximately twelve sequences were selected from a filtered subset of results with <70% identity to the query sequence. Approximately another twelve sequences were selected from a subset of sequences with >70% identity to the query sequences.

The open reading frame (ORF) of $Cronobacter$ $sakazakaii$ threonine aldolase was codon-optimized for $E.$ $coli$ (SEQ ID NO:183) and synthesized as a gBlock Gene Fragment (IDT). The 24 ltaE variants were amplified by PCR using commercially sourced oligos and cloned into a multi-copy plasmid p15A based sequence (SEQ ID NO: 239) containing a promoter pMB038 (SEQ ID NO: 237) and the native $E.$ $coli$ thrL transcription terminator (SEQ ID NO: 238) as shown in FIG. 12.

Each plasmid was initially transformed into chemically competent NEB 10-beta $E.$ $coli$ cells using standard heat shock transformation techniques in order to identify correctly assembled clones, and to amplify vector DNA for transformation into the $E.$ $coli$ threonine base strain.

Validated clones were transformed into $E.$ $coli$ base strain cells via electroporation. Each newly created strain and its parent strain was tested for threonine yield in small scale cultures as described above. The results of the experiment are presented in Table 14. Alleles ltaE_6 (SEQ ID NO: 196), ltaE_11 (SEQ ID NO: 206), ltaE_18 (SEQ ID NO: 220), ltaE_20 (SEQ ID NO: 224), lta_24 (SEQ ID NO: 232), and each increased threonine titer compared to the thrABC+ p15A empty vector control (Control Plasmid) and W3310 stains (FIG. 14).

TABLE 14

Summary of titer of strains overexpressing of ltaE variants.

| Strain # | ID | Titer | STDEV |
|---|---|---|---|
| 7000342684 | ltaE 3 | 0.00 | 0.00 |
| 7000342681 | ltaE_4 | 0.00 | 0.00 |
| 7000342698 | ltaE 6 | 8.33 | 7.24 |
| 7000342707 | ltaE_11 | 31.34 | 24.31 |
| 7000342713 | ltaE_13 | 0.00 | 0.00 |
| 7000342668 | ltaE_14 | 0.00 | 0.00 |
| 7000342685 | ltaE_15 | 0.79 | 1.37 |
| 7000342682 | ltaE_16 | 0.00 | 0.00 |
| 7000342678 | ltaE_17 | 1.19 | 2.06 |
| 7000342675 | ltaE_18 | 17.85 | 9.29 |
| 7000342694 | ltaE_19 | 0.00 | 0.00 |
| 7000342695 | ltaE 20 | 11.50 | 2.99 |
| 7000342690 | ltaE_21 | 1.98 | 3.44 |
| 7000342710 | ltaE_22 | 0.00 | 0.00 |
| 7000342715 | ltaE_24 | 10.71 | 18.55 |

TABLE 14-continued

Summary of titer of strains overexpressing of ltaE variants.

| Strain # | ID | Titer | STDEV |
|---|---|---|---|
| 7000347664 | thrABC p15A control | 2.38 | 2.26 |
| 7000284155 | W3110 | 0.00 | 0.00 |

Example 7: Expressing Combinations of Modified or Variant gapA, Gdh, Asd, and ltaE Enzymes in E. coli to Increase L-Threonine Production The base strain described in Example 2 was used for the following example experiments.

One or more of the above strategies may be used in combination to further increase NADPH production and, therefore, increase the yield of L-threonine in E. coli. Various combinations of gapA, gsd, asd, ltaE were introduced into E. coli thrABCΔtdh background described in Example 2. In some cases these combinations were cloned into and transformed on the same modified pUC19 vector containing pMB085-thrABC, as polycistronic additions downstream of thrABC operon and driven by the pMB085 promoter, using commercially sourced oligonucleotides, as described above. When multiple genes were added in tandem, the following ribosome binding site (RBS) linkers were included: RBS1 (agctggtggaatat (SEQ ID NO: 306); after thrC), RBS2 (aggaggttgt (SEQ ID NO: 307); between gene 1 and 2), and RBS3 (tgacacctattg (SEQ ID NO: 308); between gene 2 and 3). These linker sequences were included in oligonucleotide tails and introduced during PCR amplification of the genes. When combination of gapA, gsd, asd, ltaE were expressed as a polycistronic operons with thrABC titers up to and greater than 15 mg/L of threonine were observed for certain combinations (FIG. 11A-C) and TABLE 15.

TABLE 15

Summary of titer of strains co-expressing thrABC and combinations of gapA, asd, gdh and ltaE on pUC19 plasmid.

| Strain # | ID | Titer | STDEV |
|---|---|---|---|
| 7000284155 | W3110 | 0.00 | 0.00 |
| 7000334740 | tdh_del | 0.00 | 0.00 |
| 7000336113 | thrLABC | 0.00 | 0.00 |
| 7000341282 | thrABC | 0.79 | 1.37 |
| 7000342722 | Ec_asd | 3.17 | 3.64 |
| 7000342724 | Ec_gdh | 15.07 | 8.10 |
| 7000342725 | Ec_ltaE | 0.00 | 0.00 |
| 7000342723 | Ec_gapA | 0.79 | 1.37 |
| 7000342735 | Ec_asd + Ec_gdh | 0.00 | 0.00 |
| 7000342736 | Ec_gapA + Ec_gdh | 16.66 | 6.73 |
| 7000342719 | Lag_asd | 8.33 | 4.29 |
| 7000342721 | Csy_gdh | 15.87 | 4.81 |
| 7000342728 | Lag_asd + Csy_gdh | 0.00 | 0.00 |
| 7000342737 | Lag_asd + Csy_gdh + Csa_ltaE | 13.09 | 10.10 |
| 7000342742 | Lag_asd + Csy_gdh + Csa_ltaE | 14.28 | 2.06 |
| 7000342726 | gapAv5 | 19.04 | 8.33 |
| 7000342720 | gapAv7 | 15.47 | 9.45 |
| 7000342727 | gapAv8 | 8.73 | 4.18 |
| 7000342731 | gapAv5 + Csy_gdh | 0.00 | 0.00 |
| 7000342729 | gapAv5 + Csy_gdh + Csa_ltaE | 4.76 | 8.24 |
| 7000342730 | gapAv5 + Csy_gdh + Lag_asd | 0.00 | 0.00 |
| 7000342733 | gapAv7 + Csy_gdh | 10.31 | 6.87 |
| 7000342732 | gapAv7 + Csy_gdh + Csa_ltaE | 1.98 | 3.44 |
| 7000342734 | gapAv8 + Csy_gdh | 1.19 | 2.06 |

In addition to the above combinations of genes that expressed polycistronically on the pUC19 plasmid, we also transformed three of the above strains (7000342721, 7000342726 and 7000342720; Csy_gdh (SEQ ID NO: 44), gapAv5 (SEQ ID NO: 69) and gapAv7 (SEQ ID NO: 71), respectively) with p15A plasmids (SEQ ID NO: 239) expressing individual library variants of asd, gdh and ltaE (described and tested above) or an empty p15A vector control (e.g., Csy_gdh+p15A(−)). A summary of these strains and their performance (threonine titer) is shown in TABLE 16. All of these strains, except W3110 are in a pMB085-thrABC tdh deletion background. For these experiments, the most relevant controls are the parents strain (Csy_gdh, gapAv5 and gapAv7) transformed with the empty p15A control plasmid (7000349886, 7000349887 and 7000349885; Csy_gdh+p15A(−), gapAv5+p15A(−) and gapAv7+p15A(−), respectively). Certain combinations of asd, gdh, or ltaE variants with Csy_gdh, gapAv5 or gapAv7 improved threonine titer. At least one biological replicate performed better than the relevant control strains for many of the strains expressing an asd, gdh or ltaE library variant (FIG. 15). We feel that the individual biological replicates that resulted in improved threonine titer are indicative of the improvement resulting from these combinations. The high variablility (large standard deviations resulting from a large number of replicates failing to produce threonine) is likely a result of plasmid instability or high rate of mutation when the strain is maintaining two plasmids, but could be alleviated by chromosomal integration of these genes. Maintenance of the additional p15A plasmid and growth in chloramphenical also resulted in lower titer observed in strains maintaining the two plasmids relative to parents (e.g., the-p15A(−) plasmids relative to the parent).

TABLE 16

Summary of titer of strains expressing combinations of either Csy_gdh, gapAv5 or gapAv7 with asd, gdh or ltaE library variants.

| Strain # | Strain Genotype | Titer | STDEV |
|---|---|---|---|
| 7000284155 | W3110 | 0.00 | 0.00 |
| 7000341282 | pMB085-thrABC | 21.44 | 14.44 |
| 7000342721 | Csy_gdh | 29.78 | 26.34 |
| 7000349838 | Csy_gdh + asd_13 | 8.74 | 8.94 |
| 7000349878 | Csy_gdh + asd_18 | 11.51 | 19.94 |
| 7000349840 | Csy_gdh + gdh_08 | 16.28 | 28.20 |
| 7000349847 | Csy_gdh + gdh_14 | 0.00 | 0.00 |
| 7000349850 | Csy_gdh + gdh_16 | 19.26 | 20.92 |
| 7000349851 | Csy_gdh + gdh_18 | 0.00 | 0.00 |
| 7000349881 | Csy_gdh + gdh_20 | 0.00 | 0.00 |
| 7000349855 | Csy_gdh + gdh_22 | 25.02 | 31.15 |
| 7000349853 | Csy_gdh + ltaE_06 | 0.00 | 0.00 |
| 7000349867 | Csy_gdh + ltaE_11 | 0.00 | 0.00 |
| 7000349849 | Csy_gdh + ltaE_18 | 0.00 | 0.00 |
| 7000349844 | Csy_gdh + ltaE_20 | 16.68 | 28.89 |
| 7000349869 | Csy_gdh + ltaE_24 | 0.00 | 0.00 |
| 7000349886 | Csy_gdh + p15A(−) | 8.74 | 21.40 |
| 7000342726 | gapAv5 | 29.78 | 2.06 |
| 7000349870 | gapAv5 + asd_13 | 0.00 | 0.00 |
| 7000349880 | gapAv5 + asd_18 | 7.15 | 9.45 |
| 7000349864 | gapAv5 + gdh_08 | 0.00 | 0.00 |
| 7000349857 | gapAv5 + gdh_14 | 19.85 | 34.39 |
| 7000349876 | gapAv5 + gdh_16 | 16.68 | 26.85 |
| 7000349872 | gapAv5 + gdh_18 | 0.00 | 0.00 |
| 7000349884 | gapAv5 + gdh_20 | 0.00 | 0.00 |
| 7000349862 | gapAv5 + gdh_22 | 17.87 | 30.95 |
| 7000349874 | gapAv5 + ltaE_06 | 0.00 | 0.00 |
| 7000349863 | gapAv5 + ltaE_11 | 0.79 | 1.38 |
| 7000349866 | gapAv5 + ltaE_18 | 0.00 | 0.00 |
| 7000349861 | gapAv5 + ltaE_20 | 6.35 | 11.00 |
| 7000349871 | gapAv5 + ltaE_24 | 8.74 | 15.13 |
| 7000349887 | gapAv5 + p15A(−) | 0.79 | 1.95 |
| 7000342720 | gapAv7 | 36.13 | 1.82 |
| 7000349835 | gapAv7 + asd_13 | 0.79 | 1.38 |
| 7000349848 | gapAv7 + asd_18 | 10.72 | 13.74 |

TABLE 16-continued

Summary of titer of strains expressing combinations of either Csy_gdh, gapAv5 or gapAv7 with asd, gdh or ltaE library variants.

| Strain # | Strain Genotype | Titer | STDEV |
|---|---|---|---|
| 7000349877 | gapAv7 + gdh_08 | 0.00 | 0.00 |
| 7000349833 | gapAv7 + gdh_14 | 7.45 | 8.72 |
| 7000349875 | gapAv7 + gdh_16 | 6.35 | 7.28 |
| 7000349879 | gapAv7 + gdh_18 | 0.00 | 0.00 |
| 7000349846 | gapAv7 + gdh_20 | 0.00 | 0.00 |
| 7000349842 | gapAv7 + gdh_22 | 21.44 | 29.92 |
| 7000349873 | gapAv7 + ltaE_06 | 0.00 | 0.00 |
| 7000349839 | gapAv7 + ltaE_11 | 0.00 | 0.00 |
| 7000349883 | gapAv7 + ltaE_18 | 0.00 | 0.00 |
| 7000349837 | gapAv7 + ltaE_20 | 0.00 | 0.00 |
| 7000349843 | gapAv7 + ltaE_24 | 0.00 | 0.00 |
| 7000349885 | gapAv7 + p15A(−) | 1.59 | 3.89 |

Example 8: Expressing Transhydrogenase to Create NADPH from NADH

A critical factor in the biotechnological production of L-lysine in *C. glutamicum* is the sufficient supply of NADPH. As shown in FIG. 1, the membrane-integral nicotinamide nucleotide transhydrogenase enzyme can drive the reduction of $NADP^+$ via the oxidation of NADH, thereby generating NADPH from NADH. Thus expression of a transhydrogenase is an effective strategy to increase cellular NADPH production, and therefore L-lysine production, in *C. glutamicum*.

Example 9: Expressing Pyruvate Carboyxlase

Pyruvate carboxylate is an important anaplerotic enzyme replenishing oxaloacetate consumed for biosynthesis during growth, or lysine and glutamic acid production in industrial fermentations.

Pruvate carboxylase genes have been cloned and sequenced from: *Rhizobium etli* (Dunn, F. F., et al., *J. Bacteriol.* 178:5960-5970 (1996)), *Bacillus stearothermophilus* (Kondo, H., et al., *Gene* 191:47-50 (1997), *Bacillus subtillis* (Genbank accession no. Z97025), *Mycobacterium tuberculosis* (Genbank accession no. Z83018), and *Methanobacterium thermoautotrophicum* (Mukhopadhyay, B., *J. Biol. Chem.* 273:5155-5166 (1998). Pyruvate carboxylase activity has been measured previously in *Brevibacterium lactofermentum* (Tosaka, O., et al., *Agric. Biol. Chem.* 43:1513-1519 (1979)) and *Corynebacterium glutamicum* (Peters-Wendisch, P. G., et al., *Microbiology* 143:1095-1103 (1997).

Research has indicated that the yield and productivity of the aspartate family of amino acids depends critically on the carbon flux through anaplerotic pathways (Vallino, J. J., & Stephanopoulos, G., *Biotechnol. Bioeng.* 41:633-646 (1993)). On the basis of the metabolite balances, it can be shown that the rate of lysine production is less than or equal to the rate of oxaloacetate synthesis via the anaplerotic pathways The pyruvate carboxylase gene of *C. glutamicum* may be replaced with a mutants or variants whereby preferably pyruvate carboxylase is expressed 2 to 20 fold higher than its expression in the *C. glutamicum* base strain.

*E. coli* is thought to lack an endogenous pyruvate carboxylase gene. A heterologous pyruvate carboxylase may be provided. A heterologous pyruvate carboxylase gene from *C. glutamicum* or another microorganism may be introduced into any *E. coli* strain, such as, for example the base strains described in Example 2. In some application, precise modulation or fine-tuning of the expression level of an endogenous or heterologous pyruvate carboxylase may be desirable in that less than optimal outcomes may be achieved either with insufficient pyruvate carboxylase activity or excessive pyruvate carboxylase activity due to expression levels or activity levels of mutant or variant pyc gene. In such cases, promoter ladders can be used to modulate or fine-tune expression. By testing promoter elements of varying strength in combination with various pyc variants or mutants, combinations of promoter and pyc gene that result in optimal gene activity can be determined, resulting in increased production of a desired compound, such as L-threonine.

Example 10: Expressing Combinations of Modified gapA, Transhydrogenase, and Modified Gdh, Asd, dapB, and Ddh Enzymes in *C. Glutamicum* or *E. coli* to Increase L-Lysine or L-Threonine Production One or more of the above strategies may be used in combination to further increase NADPH production and, therefore, increase the yield of L-lysine or L-threonine in *C. glutamicum* or *E. coli*.

Example 11: Identification of Novel Glyceraldehyde 3-Phosphate Dehydrogenase (GAPDH) Alleles An NNK library of gapA genes was generated using gapAv9 (D35G, L36T, T37K, P192S) (SEQ ID NO: 303) as the starting sequence. Each mutagenized gene was introduced individually as a second copy of gapA at a neutral integration locus (in between cg1504 and cg1505) under the regulation of the native gapA promoter in a *C. glutamicum* having an endogenous gapA allele. More than 1200 gapA integrants were screened in two different plate assays to identify alleles that improve lysine titer. Certain integrants showed increased expression of lysine (black circles) compared to the parent strain (black diamond) (FIG. 14).

Several truncated gapA sequences resulted in increased lysine expression. The native gapA sequence is underlined. The remaining amino acids are an artifact of frame-shift mutation.

TABLE 17 gapA Truncations the Increase Lysine Expression

| Strain | Sequence | SEQ ID NO |
|---|---|---|
| 331829 | MTIRVGINGFGRIGRNFFR AILERSDDLEVVAVNGTK DNKTLSTLLKFDSIMGRL GQEVEYDDDSINEGLRQH RQGCFLVRQRVGLHLPAP ASDRARSFQAL* | 233 |
| 331831 | MTIRVGINGFGRIGRNFFR AILERSDDLEVVAVNGTK DNKTLSTLLKFDSIMGTK DNKTLSTLLKFDSISR* | 234 |
| 331897 | MTIRVGINGFGRIGRNFFR AILERSDDLEVVAVNGTK DNKTLSTLLKFDSIMGRL GQEVEYDDDSITVGGKRI AVYAERDPKNLDWAATT LTS* | 235 |
| 331904 | MTIRVGINGFGRIGRNFFV AGAKKVIISRCKRG* | 236 |

TABLE 18

List of new mutations in gapA gene that improve lysine production.

| Mutation | Strain | Plate model | Titer mM (95% CI) | Parent titer mM (95% CI) | % improvement over parent |
|---|---|---|---|---|---|
| L224S | 331772 | #2 | 34.1 +/− 5.4 | 31 +/− 0.36 | 10 |
| H110D | 331828 | #1 | 27.7 +/− 2.2 | 23.3 +/− 0.5 | 18.9 |
| Trunc (102 aa) SEQ ID NO: 233 | 331829 | #1 | 26.4 +/− 1.5 | 23.3 +/− 0.5 | 13.3 |
| Trunc (71 aa) SEQ ID NO: 234 | 331831 | #1 | 26.8 +/− 2.3 | 23.3 +/− 0.5 | 15 |
| Trunc (93 aa) SEQ ID NO: 235 | 331897 | #1 | 29.3 +/− 3.8 | 23.3 +/− 0.5 | 25.8 |
| Trunc (33 aa) SEQ ID NO: 236 | 331904 | #1 | 29.6 +/− 1 | 23.3 +/− 0.5 | 27 |
| K37P | 331009 | #2 | 29.3 +/− 4.8 | 27.3 +/− 0.24 | 7.3 |
| Y140G | 331005 | #1 | 21.6 +/− 0.5 | 19.7 +/− 0.3 | 9.6 |

SEQUENCES OF THE DISCLOSURE WITH SEQ ID NO IDENTIFIERS

Gene Homologues

| Gene | Source | Code | Amino Acid SEQ ID NO: | Polynucleotide SEQ ID NO: |
|---|---|---|---|---|
| ddh | A. oris | ddh_Aor | 2 | 1 |
| ddh | C. glutamicum | ddh_Cgl | 4 | 3 |
| ddh | H. archaeon | ddh_Har | 6 | 5 |
| ddh | coprobacillus | ddh_Cop | 8 | 7 |
| ddh | M. harundinacea | ddh_Mha | 10 | 9 |
| ddh | M. micronuciformis | ddh_Mmi | 12 | 11 |
| ddh | A. denitrificans | ddh_Ade | 14 | 13 |
| ddh | M. luteus | ddh_Mlu | 16 | 15 |
| ddh | B. faecium | ddh_Bfae | 18 | 17 |
| ddh | carnobacterium | ddh_Car | 20 | 19 |
| asd | M. jannaschii | asd_Mja | 22 | 21 |
| asd | S. usitatus | asd_Sus | 24 | 23 |
| asd | N. innermongolicus | asd_Nin | 26 | 25 |
| asd | C. aurantiacus | asd_Cau | 28 | 27 |
| asd | L. agilis | asd_Lag | 30 | 29 |
| asd | B. pullorum | asd_Bpu | 32 | 31 |
| asd | B. bacterium | asd_Bba | 34 | 33 |
| asd | M. hansupus | asd_Mha | 36 | 35 |
| asd | P. sabinae | asd_Psa | 38 | 37 |
| asd | C. glutamicum | asd_Cgl | 40 | 39 |
| gdh | C. glutamicum | gdh_Cgl | 42 | 41 |
| gdh | C. symbiosum | gdh_Csy | 44 | 43 |
| dapB | C. glutamicum | dapB_Cgl | 46 | 45 |
| dapB | E. coli | dapB_Eco | 48 | 47 |
| aspK | C. glutamicum | aspK10 | 50 | 49 |

Parts Used in Assembly of asd-gdh-dapB-ddh Combinations

| Description | Source | Description | Amino Acid SEQ ID NO: | Polynucleotide SEQ ID NO: |
|---|---|---|---|---|
| Cloning plasmid | Artificial | Vector Backbone | n/a | 51 |
| Insertion Site Sequences | Artificial | Vector/Promoter | n/a | 52-57 |
| gapA | C. glutamicum | Coding Sequence | n/a | 58 |
| ask | C. glutamicum | Coding Sequence | 305 | 304 |

Exemplary Promoters

| Full Name | Source | Short Name | Amino Acid SEQ ID NO: | Polynucleotide SEQ ID NO: |
|---|---|---|---|---|
| Pcg0007_lib_39 | Artificial | P1 | n/a | 59 |
| Pcg0007 | Artificial | P2 | n/a | 60 |
| Peg1860 | Artificial | P3 | n/a | 61 |
| Pcg0755 | Artificial | P4 | n/a | 62 |
| Pcg0007_265 | Artificial | P5 | n/a | 63 |
| Pcg3381 | Artificial | P6 | n/a | 64 |

SEQUENCES OF THE DISCLOSURE WITH SEQ ID NO IDENTIFIERS

| | | | | |
|---|---|---|---|---|
| Pcg0007_119 | Artificial | P7 | n/a | 65 |
| Pcg3121 | Artificial | P8 | n/a | 66 |

Sequences of gapA Mutants

| Name | Source | Mutations(s) | Amino Acid SEQ ID NO: | Polynucleotide SEQ ID NO: |
|---|---|---|---|---|
| gapA | E. coli | wildtype | 67 | 68 |
| gapAv5 | C. glutamicum | D35G L36T | 69 | 70 |
| gapAv7 | C. glutamicum | L36T T37K | 71 | 72 |
| gapAv8 | C. glutamicum | D35G L36T T37K | 73 | 74 |
| gapAv9 | C. glutamicum | D35G L36T T37K P192S | 303 | 302 |

Parts Used in Assembly of Threonine-Expressing Base Strains

| Name | Source | Description | Amino Acid SEQ ID NO: | Polynucleotide SEQ ID NO: |
|---|---|---|---|---|
| pMB085 | Artificial | Promoter | n/a | 75 |
| thrLABC | E. coli | Operon | n/a | 76 |
| thrABC | E. coli | Operon | n/a | 77 |
| pUC19 vector | Artificial | Vector Backbone | n/a | 78 |

Additional Gene Homologues

| Gene | Source | Code | Amino Acid SEQ ID NO: | Polynucleotide SEQ ID NO: |
|---|---|---|---|---|
| asd | Lactobacillus agilis | asd_Lag | 80 | 79 |
| asd | E. coli | asd_Ec | 82 | 81 |
| asd | unknown | asd_1 | 84 | 83 |
| asd | unknown | asd_2 | 86 | 85 |
| asd | unknown | asd_3 | 88 | 87 |
| asd | unknown | asd_4 | 90 | 89 |
| asd | unknown | asd_5 | 92 | 91 |
| asd | unknown | asd_6 | 94 | 93 |
| asd | unknown | asd_7 | 96 | 95 |
| asd | unknown | asd_8 | 98 | 97 |
| asd | unknown | asd_9 | 100 | 99 |
| asd | unknown | asd_10 | 102 | 101 |
| asd | unknown | asd_11 | 104 | 103 |
| asd | unknown | asd_12 | 106 | 105 |
| asd | unknown | asd_13 | 108 | 107 |
| asd | unknown | asd_14 | 110 | 109 |
| asd | unknown | asd_15 | 112 | 111 |
| asd | unknown | asd_16 | 114 | 113 |
| asd | unknown | asd_17 | 116 | 115 |
| asd | unknown | asd_18 | 118 | 117 |
| asd | unknown | asd_19 | 120 | 119 |
| asd | unknown | asd_20 | 122 | 121 |
| asd | unknown | asd_21 | 124 | 123 |
| asd | unknown | asd_22 | 126 | 125 |
| asd | unknown | asd_23 | 128 | 127 |
| asd | unknown | asd_24 | 130 | 129 |
| gdh | Clostridiales | gdh_Csy | 132 | 131 |
| gdh | E. coli | gdh_Ec | 134 | 133 |
| gdh | unknown | gdh_1 | 136 | 135 |
| gdh | unknown | gdh_2 | 138 | 137 |
| gdh | unknown | gdh_3 | 140 | 139 |
| gdh | unknown | gdh_4 | 142 | 141 |
| gdh | unknown | gdh_5 | 144 | 143 |
| gdh | unknown | gdh_6 | 146 | 145 |
| gdh | unknown | gdh_7 | 148 | 147 |
| gdh | unknown | gdh_8 | 150 | 149 |
| gdh | unknown | gdh_9 | 152 | 151 |
| gdh | unknown | gdh_10 | 154 | 153 |
| gdh | unknown | gdh_11 | 156 | 155 |
| gdh | unknown | gdh_12 | 158 | 157 |
| gdh | unknown | gdh_13 | 160 | 159 |
| gdh | unknown | gdh_14 | 162 | 161 |
| gdh | unknown | gdh_15 | 164 | 163 |
| gdh | unknown | gdh_16 | 166 | 165 |
| gdh | unknown | gdh_17 | 168 | 167 |
| gdh | unknown | gdh_18 | 170 | 169 |
| gdh | unknown | gdh_19 | 172 | 171 |

SEQUENCES OF THE DISCLOSURE WITH SEQ ID NO IDENTIFIERS

| | | | | |
|---|---|---|---|---|
| gdh | unknown | gdh__20 | 174 | 173 |
| gdh | unknown | gdh__21 | 176 | 175 |
| gdh | unknown | gdh__22 | 178 | 177 |
| gdh | unknown | gdh__23 | 180 | 179 |
| gdh | unknown | gdh__24 | 182 | 181 |
| ltaE | C. sakazakaii | ltaE__Csa | 184 | 183 |
| ltaE | unknown | ltaE__1 | 186 | 185 |
| ltaE | unknown | ltaE__2 | 188 | 187 |
| ltaE | unknown | ltaE__3 | 190 | 189 |
| ltaE | unknown | ltaE__4 | 192 | 191 |
| ltaE | unknown | ltaE__5 | 194 | 193 |
| ltaE | unknown | ltaE__6 | 196 | 195 |
| ltaE | unknown | ltaE__7 | 198 | 197 |
| ltaE | unknown | ltaE__8 | 200 | 199 |
| ltaE | unknown | ltaE__9 | 202 | 201 |
| ltaE | unknown | ltaE__10 | 204 | 203 |
| ltaE | unknown | ltaE__11 | 206 | 205 |
| ltaE | unknown | ltaE__12 | 208 | 207 |
| ltaE | unknown | ltaE__13 | 210 | 209 |
| ltaE | unknown | ltaE__14 | 212 | 211 |
| ltaE | unknown | ltaE__15 | 214 | 213 |
| ltaE | unknown | ltaE__16 | 216 | 215 |
| ltaE | unknown | ltaE__17 | 218 | 217 |
| ltaE | unknown | ltaE__18 | 220 | 219 |
| ltaE | unknown | ltaE__19 | 222 | 221 |
| ltaE | unknown | ltaE__20 | 224 | 223 |
| ltaE | unknown | ltaE__21 | 226 | 225 |
| ltaE | unknown | ltaE__22 | 228 | 227 |
| ltaE | unknown | ltaE__23 | 230 | 229 |
| ltaE | unknown | ltaE__24 | 232 | 231 |

Sequences of gapA Mutants

| Name | Source | Strain Number | Amino Acid SEQ ID NO: | Polynucleotide SEQ ID NO: |
|---|---|---|---|---|
| gapAv9-L224S | C. glutamicum | 331772 | 294 | 295 |
| gapAv9-H110D | C. glutamicum | 331828 | 296 | 297 |
| gapAv9-Trunc (102 aa) | C. glutamicum | 331829 | 233 | 290 |
| gapAv9-Trunc (71 aa) | C. glutamicum | 331831 | 234 | 291 |
| gapAv9-Trunc (93 aa) | C. glutamicum | 331897 | 235 | 292 |
| gapAv9-Trunc (33 aa) | C. glutamicum | 331904 | 236 | 293 |
| gapAv9-K37P | C. glutamicum | 331009 | 298 | 299 |
| gapAv9-Y140G | C. glutamicum | 331005 | 300 | 301 |

Parts Used in Assembly of asd-gdh Combinations

| Description | Source | Description | Amino Acid SEQ ID NO: | Polynucleotide SEQ ID NO: |
|---|---|---|---|---|
| pMB038 promoter | Artificial | Promoter | n/a | 237 |
| thrL terminator | Artificial | Terminator | n/a | 238 |
| p15A plasmid backbone | Artificial | Vector Backbone | n/a | 239 |

Additional Gene Homologues

| Gene | Source | Code | Amino Acid SEQ ID NO: | Polynucleotide SEQ ID NO: |
|---|---|---|---|---|
| pyc | C. sakazakaii | pyc__Cgl | 241 | 240 |
| pyc | unknown | pyc__1 | 243 | 242 |
| pyc | unknown | pyc__2 | 245 | 244 |
| pyc | unknown | pyc__3 | 247 | 246 |
| pyc | unknown | pyc__4 | 249 | 248 |
| pyc | unknown | pyc__5 | 251 | 250 |
| pyc | unknown | pyc__6 | 253 | 252 |
| pyc | unknown | pyc__7 | 255 | 254 |
| pyc | unknown | pyc__8 | 257 | 256 |
| pyc | unknown | pyc__9 | 259 | 258 |
| pyc | unknown | pyc__10 | 261 | 260 |
| pyc | unknown | pyc__11 | 263 | 262 |

-continued

| SEQUENCES OF THE DISCLOSURE WITH SEQ ID NO IDENTIFIERS | | | | |
|---|---|---|---|---|
| pyc | unknown | pyc_12 | 265 | 264 |
| pyc | unknown | pyc_13 | 267 | 266 |
| pyc | unknown | pyc_14 | 269 | 268 |
| pyc | unknown | pyc_15 | 271 | 270 |
| pyc | unknown | pyc_16 | 273 | 272 |
| pyc | unknown | pyc_17 | 275 | 274 |
| pyc | unknown | pyc_18 | 277 | 276 |
| pyc | unknown | pyc_19 | 279 | 278 |
| pyc | unknown | pyc_20 | 281 | 280 |
| pyc | unknown | pyc_21 | 283 | 282 |
| pyc | unknown | pyc_22 | 285 | 284 |
| pyc | unknown | pyc_23 | 287 | 286 |
| pyc | unknown | pyc_24 | 289 | 288 |

| Other Parts | | | | |
|---|---|---|---|---|
| Name | Source | Description | Amino Acid SEQ ID NO: | Polynucleotide SEQ ID NO: |
| RBS1 | Artificial | Ribosome binding site | n/a | 306 |
| RBS2 | Artificial | Ribosome binding site | n/a | 307 |
| RBS3 | Artificial | Ribosome binding site | n/a | 308 |

NUMBERED EMBODIMENTS OF THE DISCLOSURE

Notwithstanding the appended clauses, the disclosure sets forth the following numbered embodiments.

Improving Production of a Compound Produced Using NADPH

1. A method of improving a host cell's ability to produce a compound produced using NADPH, the method comprising altering the cell's available NADPH.
2. The method of clause 1, wherein the available NADPH is altered by expressing a modified Glyceraldehyde-3-phosphate dehydrogenase (GAPDH) in the cell, wherein the modified GAPDH is modified such that its coenzyme specificity is broadened.
3. The method of clause 2, wherein the modified GAPDH has an increased specificity to coenzyme NADP relative to the corresponding naturally occurring GAPDH.
4. The method of clause 3, wherein the naturally occurring GAPDH is gapA.
5. The method of clause 4, wherein the gapA has an amino acid sequence of SEQ ID NO:58.
6. The method of any one of clauses 2-5, wherein the modified GAPDH comprises an amino acid sequence that shares at least 70% sequence identity to the amino acid sequence of SEQ ID NO:58.
7. The method of any one of clauses 2-5, wherein the modified GAPDH comprises an amino acid sequence that shares at least 70% sequence identity to an amino acid sequence selected from the group consisting of SEQ ID NO:294, 296, 233, 234, 235, 236, 298, and 300.
8. The method of any one of clauses 2-7, wherein the modified GAPDH comprises an amino acid replacement in a position that corresponds to amino acid 37 of SEQ ID NO:58.
9. The method of any one of clauses 2-8, wherein the modified GAPDH comprises amino acid replacements in positions that correspond to amino acids 36 and 37 of SEQ ID NO:58.
10. The method of clause 8 or 9, wherein the residue in the position of the modified GAPDH that corresponds to amino acid 37 of SEQ ID NO:58 is lysine.
11. The method of clause 9, wherein the residue in the position of the modified GAPDH that corresponds to amino acid 36 of SEQ ID NO:58 is by threonine, and the residue in the position of the modified GAPDH that corresponds to amino acid 37 of SEQ ID NO:58 is lysine.
12. The method of any one of clauses 2-11, wherein the modified GAPDH comprises an amino acid replacement in a position that corresponds to amino acid 192 of SEQ ID NO:58.
13. The method of clause 12, wherein the residue in the position of the modified GAPDH that corresponds to amino acid 192 of SEQ ID NO:58 is serine.
14. The method of any one of clauses 2-13, wherein the residue in the position of the modified GAPDH that corresponds to amino acid 224 of SEQ ID NO:58 is serine.
15. The method of any one of clauses 2-14, wherein the residue in the position of the modified GAPDH that corresponds to amino acid 110 of SEQ ID NO:58 is aspartic acid.
16. The method of any one of clauses 2-15, wherein the residue in the position of the modified GAPDH that corresponds to amino acid 140 of SEQ ID NO:58 is glycine.
17. The method of any one of clauses 2-5, wherein the modified GAPDH comprises an amino acid sequence identical to an amino acid sequence selected from the group consisting of SEQ ID NO:69, 71, 73, 303, 294, 296, 233, 234, 235, 236, 298, and 300.
18. The method of any one of clauses 1-17, wherein the compound is selected from Table 2.
19. The method of clause 18, wherein the compound is lysine.
20. The method of clause 18, wherein the compound is threonine.
21. The method of any one of clauses 1-20, wherein the host cell is a prokaryotic cell.
22. The method of clause 21, wherein the host cell is from a genus selected from the group consisting of *Agrobacterium, Alicyclobacillus, Anabaena, Anacystis, Acinetobacter, Acidothermus, Arthrobacter, Azobacter, Bacillus, Bifidobacterium, Brevibacterium, Butyrivi-* brio, Buchnera, Campestris, Camplyobacter, Clostridium, Corynebacterium, Chromatium, Coprococcus, Escherichia, Enterococcus, Enterobacter, Erwinia, Fusobacterium, Faecalibacterium, Francisella, Flavobacterium, Geobacillus, Haemophilus, Helicobacter, Klebsiella, Lactobacillus, Lactococcus, Ilyobacter, Micrococcus, Microbacterium, Mesorhizobium, Methylobacterium, Methylobacterium, Mycobacterium, Neisseria, Pantoea, Pseudomonas, Prochlorococcus, Rhodobacter, Rhodopseudomonas, Rhodopseudomonas, Roseburia, Rhodospirillum, Rhodococcus, Scenedesmus, Streptomyces, Streptococcus, Synecoccus, Saccharomonospora, Staphylococcus, Serratia, Salmonella, Shigella, Thermoanaerobacterium, Tropheryma, Tularensis, Temecula, Thermosynechococcus, Thermococcus, Ureaplasma, Xanthomonas, Xylella, Yersinia, and Zymomonas.

23. The method of clause 22, wherein the host cell is *Corynebacterium glutamicum*.

24. The method of clause 22, wherein the host cell is *E. coli*.

25. The method of any one of clauses 1-20, wherein the host cell is a eukaryotic cell.

26. The method of clause 25, wherein the host cell is from a genus selected from the group consisting of *Achlya, Acremonium, Aspergillus, Aureobasidium, Bjerkandera, Ceriporiopsis, Cephalosporium, Chrysosporium, Cochliobolus, Corynascus, Cryphonectria, Cryptococcus, Coprinus, Coriolus, Diplodia, Endothis, Fusarium, Gibberella, Gliocladium, Humicola, Hypocrea, Myceliophthora, Mucor, Neurospora, Penicillium, Podospora, Phlebia, Piromyces, Pyricularia, Rhizomucor, Rhizopus, Schizophyllum, Scytalidium, Sporotrichum, Talaromyces, Thermoascus, Thielavia, Tramates, Tolypocladium, Trichoderma, Verticillium,* and *Volvariella*.

Host Cell Comprising Modified GAPDH

27. A host cell comprising a modified GAPDH having a broadened coenzyme specificity relative to a naturally existing GAPDH, wherein the host cell has improved production of a compound produced using NADPH relative to a counterpart host cell which lacks the modified GAPDH.

28. The host cell of clause 27, wherein the available NADPH is altered by expressing a modified Glyceraldehyde-3-phosphate dehydrogenase (GAPDH) in the cell, wherein the modified GAPDH is modified such that its coenzyme specificity is broadened.

29. The host cell of clause 27 or 28, wherein the modified GAPDH has an increased specificity to coenzyme NADP relative to the corresponding naturally occurring GAPDH.

30. The host cell of clause 29, wherein the naturally occurring GAPDH is gapA.

31. The host cell of clause 30, wherein the gapA has an amino acid sequence of SEQ ID NO:58.

32. The host cell of any one of clauses 27-31, wherein the modified GAPDH comprises an amino acid sequence that shares at least 70% sequence identity to the amino acid sequence of SEQ ID NO:58.

33. The host cell of any one of clauses 27-31, wherein the modified GAPDH comprises an amino acid sequence that shares at least 70% sequence identity to an amino acid sequence selected from the group consisting of SEQ ID NO:294, 296, 233, 234, 235, 236, 298, and 300.

34. The host cell of any one of clauses 27-33, wherein the modified GAPDH comprises an amino acid replacement in a position that corresponds to amino acid 37 of SEQ ID NO:58.

35. The host cell of any one of clauses 27-34, wherein the modified GAPDH comprises amino acid replacements in positions that correspond to amino acids 36 and 37 of SEQ ID NO:58.

36. The host cell of clause 34 or 35, wherein the residue in the position of the modified GAPDH that corresponds to amino acid 37 of SEQ ID NO:58 is lysine.

37. The host cell of clause 35, wherein the residue in the position of the modified GAPDH that corresponds to amino acid 36 of SEQ ID NO:58 is by threonine, and the residue in the position of the modified GAPDH that corresponds to amino acid 37 of SEQ ID NO:58 is lysine.

38. The host cell of any one of clauses 27-37, wherein the modified GAPDH comprises an amino acid replacement in a position that corresponds to amino acid 192 of SEQ ID NO:58.

39. The host cell of clause 38, wherein the residue in the position of the modified GAPDH that corresponds to amino acid 192 of SEQ ID NO:58 is serine.

40. The host cell of any one of clauses 27-39, wherein the residue in the position of the modified GAPDH that corresponds to amino acid 224 of SEQ ID NO:58 is serine.

41. The host cell of any one of clauses 27-40, wherein the residue in the position of the modified GAPDH that corresponds to amino acid 110 of SEQ ID NO:58 is aspartic acid.

42. The host cell of any one of clauses 27-41, wherein the residue in the position of the modified GAPDH that corresponds to amino acid 140 of SEQ ID NO:58 is glycine.

43. The host cell of any one of clauses 27-31, wherein the modified GAPDH comprises an amino acid sequence identical to an amino acid sequence selected from the group consisting of SEQ ID NO:69, 71, 73, 303, 294, 296, 233, 234, 235, 236, 298, and 300.

44. The host cell of any one of clauses 27-43, wherein the compound is selected from Table 2.

45. The host cell of clause 44, wherein the compound is lysine.

46. The host cell of clause 44, wherein the compound is threonine.

47. The host cell of any one of clauses 27-46, wherein the host cell is a prokaryotic cell.

48. The host cell of clause 47, wherein the host cell is from a genus selected from the group consisting of *Agrobacterium, Alicyclobacillus, Anabaena, Anacystis, Acinetobacter, Acidothermus, Arthrobacter, Azobacter, Bacillus, Bifidobacterium, Brevibacterium, Butyrivibrio, Buchnera, Campestris, Camplyobacter, Clostridium, Corynebacterium, Chromatium, Coprococcus, Escherichia, Enterococcus, Enterobacter, Erwinia, Fusobacterium, Faecalibacterium, Francisella, Flavobacterium, Geobacillus, Haemophilus, Helicobacter, Klebsiella, Lactobacillus, Lactococcus, Ilyobacter, Micrococcus, Microbacterium, Mesorhizobium, Methylobacterium, Methylobacterium, Mycobacterium, Neisseria, Pantoea, Pseudomonas, Prochlorococcus, Rhodobacter, Rhodopseudomonas, Rhodopseudomonas, Roseburia, Rhodospirillum, Rhodococcus, Scenedesmus, Streptomyces, Streptococcus, Synecoccus, Saccharomonospora, Staphylococcus,*

*Serratia, Salmonella, Shigella, Thermoanaerobacterium, Tropheryma, Tularensis, Temecula, Thermosynechococcus, Thermococcus, Ureaplasma, Xanthomonas, Xylella, Yersinia*, and *Zymomonas*.

49. The host cell of clause 48, wherein the host cell is *Corynebacterium glutamicum*.

50. The host cell of clause 48, wherein the host cell is *E. coli*.

51. The host cell of any one of clauses 27-46, wherein the host cell is a eukaryotic cell.

52. The host cell of clause 51, wherein the host cell is from a genus selected from the group consisting of *Achlya, Acremonium, Aspergillus, Aureobasidium, Bjerkandera, Ceriporiopsis, Cephalosporium, Chrysosporium, Cochliobolus, Corynascus, Cryphonectria, Cryptococcus, Coprinus, Coriolus, Diplodia, Endothis, Fusarium, Gibberella, Gliocladium, Humicola, Hypocrea, Myceliophthora, Mucor, Neurospora, Penicillium, Podospora, Phlebia, Piromyces, Pyricularia, Rhizomucor, Rhizopus, Schizophyllum, Scytalidium, Sporotrichum, Talaromyces, Thermoascus, Thielavia, Tramates, Tolypocladium, Trichoderma, Verticillium*, and *Volvariella*.

Method of Producing L-Lysine in *Corynebacterium* sp.

53. A method of producing L-lysine, comprising culturing a *Corynebacterium* sp. strain and recovering L-lysine from the cultured *Corynebacterium* sp. strain or the culture broth, wherein the *Corynebacterium* sp. strain expresses a modified GAPDH that uses NADP as a coenzyme, and wherein the *Corynebacterium* sp. strain has an improved productivity of L-lysine.

Method of Broadening Coenzyme Specificity of GAPDH

54. A method of broadening the coenzyme specificity of GAPDH comprising: modifying the GAPDH such that the modified GAPDH has dual specificity for coenzymes NADP and NAD.

55. The method of clause 54, wherein the modified GAPDH has an increased specificity to coenzyme NADP relative to NAD.

56. The method of clause 54 or 55, wherein the modified GAPDH uses NADP more effectively than NAD.

Method of Improving Efficiency of Production of a Compound Produced Using NADPH

57. A method of improving efficiency of production of a compound produced using NADPH by a host cell, comprising: expressing, in the host cell, a variant enzyme of one or more of the enzymes glutamate dehydrogenase (gdh), aspartate semialdehyde dehydrogenase (asd), dihydropicolinate reductase (dapB), and meso-diaminopimelate dehydrogenase (ddh), wherein the variant enzyme exhibits dual specificity for coenzymes NADH and NADPH.

58. The method of clause 57, wherein the compound is selected from Table 2.

59. The method of clause 57 or 58, wherein the variant enzyme uses NADH more effectively than NADPH.

60. The method of any one of clauses 57-59, wherein the method comprises expressing a variant enzyme of gdh, wherein the variant enzyme comprises an amino acid sequence that shares at least 70% sequence identity to the amino acid sequence of SEQ ID NO:42 or 44.

61. The method of any one of clauses 57-60, wherein the method comprises expressing a variant enzyme of asd, wherein the variant enzyme comprises an amino acid sequence that shares at least 70% sequence identity to the amino acid sequence of SEQ ID NO:30 or 40.

62. The method of any one of clauses 57-61, wherein the method comprises expressing a variant enzyme of dapB, wherein the variant enzyme comprises an amino acid sequence that shares at least 70% sequence identity to the amino acid sequence of SEQ ID NO:46 or 48.

63. The method of any one of clauses 57-62, wherein the method comprises expressing a variant enzyme of ddh, wherein the variant enzyme comprises an amino acid sequence that shares at least 70% sequence identity to the amino acid sequence of SEQ ID NO:4.

64. The method of any one of clauses 57-63, wherein the method comprises expressing a variant enzyme of gdh, wherein the variant enzyme comprises an amino acid sequence that shares at least 70% sequence identity to an amino acid sequence selected from the group consisting of SEQ ID NO: 132, 134, 136, 138, 140, 142, 144, 146, 148, 150, 152, 154, 156, 158, 160, 162, 164, 166, 168, 170, 172, 174, 176, 178, 180, and 182.

65. The method of any one of clauses 57-63, wherein the method comprises expressing a variant enzyme of asd, wherein the variant enzyme comprises an amino acid sequence that shares at least 70% sequence identity to an amino acid sequence selected from the group consisting of SEQ ID NO: 80, 82, 84, 86, 88, 90, 92, 94, 96, 98, 100, 102, 104, 106, 108, 110, 112, 114, 116, 118, 120, 122, 124, 126, 128, and 130.

66. The method of any one of clauses 57-63, wherein the method comprises expressing a variant enzyme of gdh, and comprises expressing a variant enzyme of asd, comprises expressing a variant enzyme of dapB, comprises expressing a variant enzyme of ddh comprises expressing a variant enzyme of ddh.

67. The method of any one of clauses 57-66, wherein the compound is selected from Table 2.

68. The method of clause 68, wherein the compound is lysine.

69. The method of clause 68, wherein the compound is threonine.

70. The method of any one of clauses 57-69, wherein the host cell is a prokaryotic cell.

71. The method of clause 70, wherein the host cell is from a genus selected from the group consisting of *Agrobacterium, Alicyclobacillus, Anabaena, Anacystis, Acinetobacter, Acidothermus, Arthrobacter, Azobacter, Bacillus, Bifidobacterium, Brevibacterium, Butyrivibrio, Buchnera, Campestris, Camplyobacter, Clostridium, Corynebacterium, Chromatium, Coprococcus, Escherichia, Enterococcus, Enterobacter, Erwinia, Fusobacterium, Faecalibacterium, Francisella, Flavobacterium, Geobacillus, Haemophilus, Helicobacter, Klebsiella, Lactobacillus, Lactococcus, Ilyobacter, Micrococcus, Microbacterium, Mesorhizobium, Methylobacterium, Methylobacterium, Mycobacterium, Neisseria, Pantoea, Pseudomonas, Prochlorococcus, Rhodobacter, Rhodopseudomonas, Rhodopseudomonas, Roseburia, Rhodospirillum, Rhodococcus, Scenedesmus, Streptomyces, Streptococcus, Synecoccus, Saccharomonospora, Staphylococcus, Serratia, Salmonella, Shigella, Thermoanaerobacterium, Tropheryma, Tularensis, Temecula, Thermosynechococcus, Thermococcus, Ureaplasma, Xanthomonas, Xylella, Yersinia*, and *Zymomonas*.

72. The method of clause 71, wherein the host cell is *Corynebacterium glutamicum*.

73. The method of clause 71, wherein the host cell is *E. coli*.

74. The method of any one of clauses 57-69, wherein the host cell is a eukaryotic cell.

75. The method of clause 74, wherein the host cell is from a genus selected from the group consisting of *Achlya, Acremonium, Aspergillus, Aureobasidium, Bjerkandera, Ceriporiopsis, Cephalosporium, Chrysosporium, Cochliobolus, Corynascus, Cryphonectria, Cryptococcus, Coprinus, Coriolus, Diplodia, Endothis, Fusarium, Gibberella, Gliocladium, Humicola, Hypocrea, Myceliophthora, Mucor, Neurospora, Penicillium, Podospora, Phlebia, Piromyces, Pyricularia, Rhizomucor, Rhizopus, Schizophyllum, Scytalidium, Sporotrichum, Talaromyces, Thermoascus, Thielavia, Tramates, Tolypocladium, Trichoderma, Verticillium,* and *Volvariella*.

Host Cell Comprising a Variant of gdh, asd, dapB, or ddh

76. A host cell comprising: a variant of one or more enzymes gdh, asd, dapB, and ddh, wherein the variant exhibits dual specificity for coenzymes NADH and NADPH.

Method Using Novel Nicotinamide Nucleotide Transhydrogenase

77. A method of improving efficiency of production of a compound produced using NADPH by a host cell, comprising expressing, in the host cell, a novel nicotinamide nucleotide transhydrogenase.

Method of Improving Efficiency of L-Lysine Production by Strategy

78. A method of improving efficiency of L-lysine production by a host cell, comprising two or more of the following:
   (1) modifying an endogenous GAPDH such that the modified GAPDH has an increased specificity to coenzyme NADP relative to the corresponding naturally occurring GAPDH;
   (2) expressing, in the host cell, a variant enzyme of one or more of the enzymes glutamate dehydrogenase (gdh), aspartate semialdehyde dehydrogenase (asd), dihydropicolinate reductase (dapB), and meso-diaminopimelate dehydrogenase (ddh), wherein the variant enzyme exhibits dual specificity for coenzymes NADH and NADPH; and
   (3) expressing, in the host cell, a novel nicotinamide nucleotide transhydrogenase.

Method Using gdh and/or asd

79. A method of improving efficiency of production of a compound produced using NADPH by a host cell, comprising: expressing, in the host cell, a variant enzyme of one or both of the enzymes glutamate dehydrogenase (gdh) and aspartate semialdehyde dehydrogenase (asd), wherein the variant enzyme exhibits dual specificity for coenzymes NADH and NADPH.

80. The method of clause 79, wherein the variant enzyme uses NADH more effectively than NADPH.

81. The method of clause 79 or 80, wherein the method comprises expressing a variant enzyme of gdh, wherein the variant enzyme comprises an amino acid sequence that shares at least 70% sequence identity to an amino acid sequence selected from the group consisting of SEQ ID NO:132, 134, 136, 138, 140, 142, 144, 146, 148, 150, 152, 154, 156, 158, 160, 162, 164, 166, 168, 170, 172, 174, 176, 178, 180, and 182.

82. The method of clause 81, wherein the variant enzyme of gdh comprises an amino acid sequence selected from the group consisting of SEQ ID NO:144, 150, 162, 166, 170, 174, and 178.

83. The method of any one of clauses 79-82, wherein the method comprises expressing a variant enzyme of asd, wherein the variant enzyme comprises an amino acid sequence that shares at least 70% sequence identity to an amino acid sequence selected from the group consisting of SEQ ID NO:80, 82, 84, 86, 88, 90, 92, 94, 96, 98, 100, 102, 104, 106, 108, 110, 112, 114, 116, 118, 120, 122, 124, 126, 128, and 130.

84. The method of clause 83, wherein the variant enzyme of asd comprises an amino acid sequence of selected from the group consisting of SEQ ID NO:108 and 118.

Method of Improving Efficiency of L-Threonine Production with Threonine Aldolase 85. A method of improving efficiency of production of L-threonine by a host cell, comprising: expressing, in the host cell, a variant enzyme of threonine aldolase, wherein the variant enzyme exhibits substrate preference or enzyme kinetics different from *E. coli* threonine aldolase (ltaE).

86. The method of clause 85, wherein the variant enzyme favors threonine production over glycine production.

87. The method of clause 85 or 86, wherein the method comprises expressing a variant enzyme of threonine aldolase, wherein the variant enzyme comprises an amino acid sequence that shares at least 70% sequence identity to an amino acid sequence selected from the group consisting of SEQ ID NO: 184, 186, 188, 190, 192, 194, 196, 198, 200, 202, 204, 206, 208, 210, 212, 214, 216, 218, 220, 222, 224, 226, 228, 230, and 232.

88. The method of clause 87, wherein the variant enzyme comprises an amino acid sequence selected from the group consisting of SEQ ID NO:196, 206, 220, 224 and 232.

89. The method of any one of clauses 85-88, wherein the host cell is a prokaryotic cell.

90. The method of clause 89, wherein the host cell is from a genus selected from the group consisting of *Agrobacterium, Alicyclobacillus, Anabaena, Anacystis, Acinetobacter, Acidothermus, Arthrobacter, Azobacter, Bacillus, Bifidobacterium, Brevibacterium, Butyrivibrio, Buchnera, Campestris, Camplyobacter, Clostridium, Corynebacterium, Chromatium, Coprococcus, Escherichia, Enterococcus, Enterobacter, Erwinia, Fusobacterium, Faecalibacterium, Francisella, Flavobacterium, Geobacillus, Haemophilus, Helicobacter, Klebsiella, Lactobacillus, Lactococcus, Ilyobacter, Micrococcus, Microbacterium, Mesorhizobium, Methylobacterium, Methylobacterium, Mycobacterium, Neisseria, Pantoea, Pseudomonas, Prochlorococcus, Rhodobacter, Rhodopseudomonas, Rhodopseudomonas, Roseburia, Rhodospirillum, Rhodococcus, Scenedesmus, Streptomyces, Streptococcus, Synecoccus, Saccharomonospora, Staphylococcus, Serratia, Salmonella, Shigella, Thermoanaerobacterium, Tropheryma, Tularensis, Temecula, Thermosynechococcus, Thermococcus, Ureaplasma, Xanthomonas, Xylella, Yersinia,* and *Zymomonas*.

91. The method of clause 90, wherein the host cell is *Corynebacterium glutamicum*.

92. The method of clause 90, wherein the host cell is *E. coli*.

93. The method of any one of clauses 85-88, wherein the host cell is a eukaryotic cell.

94. The method of clause 93, wherein the host cell is from a genus selected from the group consisting of *Achlya, Acremonium, Aspergillus, Aureobasidium, Bjerkandera, Ceriporiopsis, Cephalosporium, Chrysosporium,*

*Cochliobolus, Corynascus, Cryphonectria, Cryptococcus, Coprinus, Coriolus, Diplodia, Endothis, Fusarium, Gibberella, Gliocladium, Humicola, Hypocrea, Myceliophthora, Mucor, Neurospora, Penicillium, Podospora, Phlebia, Piromyces, Pyricularia, Rhizomucor, Rhizopus, Schizophyllum, Scytalidium, Sporotrichum, Talaromyces, Thermoascus, Thielavia, Tramates, Tolypocladium, Trichoderma, Verticillium,* and *Volvariella.*

Method of Improving Efficiency of L-Threonine Production by Variant Enzyme

95. A method of increasing L-threonine production by a host cell, comprising: expressing, in the host cell, a variant enzyme of one or more of the enzymes glyceraldehyde 3-phosphate dehydrogenase (gapA), glutamate dehydrogenase (gdh), aspartate semialdehyde dehydrogenase (asd), threonine aldolase (ltaE), and pyruvate carboxylase (pyc).

96. The method of clause 95, wherein the variant enzyme of gdh or the variant enzyme of asd exhibits dual specificity for coenzymes NADH and NADPH.

97. The method of clause 95, wherein the variant enzyme of gapA, the variant enzyme of gdh, or the variant enzyme of asd uses NADH more effectively than NADPH.

98. The method of any one of clauses 95-97, wherein the variant enzyme of threonine aldolase favors threonine production over glycine production.

99. The method of any one of clauses 95-98, wherein the method comprises expressing a variant enzyme of gdh, wherein the variant enzyme comprises an amino acid sequence that shares at least 70% sequence identity to an amino acid sequence selected from the group consisting of SEQ ID NO:132, 134, 136, 138, 140, 142, 144, 146, 148, 150, 152, 154, 156, 158, 160, 162, 164, 166, 168, 170, 172, 174, 176, 178, 180, and 182.

100. The method of clause 99, wherein the variant enzyme of gdh comprises an amino acid sequence selected from the group consisting of SEQ ID NO:144, 150, 162, 166, 170, 174, and 178.

101. The method of any one of clauses 95-100, wherein the method comprises expressing a variant enzyme of asd, wherein the variant enzyme comprises an amino acid sequence that shares at least 70% sequence identity to an amino acid sequence selected from the group consisting of SEQ ID NO:80, 82, 84, 86, 88, 90, 92, 94, 96, 98, 100, 102, 104, 106, 108, 110, 112, 114, 116, 118, 120, 122, 124, 126, 128, and 130.

102. The method of clause 101, wherein the variant enzyme of asd comprises an amino acid sequence of selected from the group consisting of SEQ ID NO:108 and 118.

103. The method of any one of clauses 95-102, wherein the method comprises expressing a variant enzyme of threonine aldolase, wherein the variant enzyme comprises an amino acid sequence that shares at least 70% sequence identity to an amino acid sequence selected from the group consisting of SEQ ID NO: 184, 186, 188, 190, 192, 194, 196, 198, 200, 202, 204, 206, 208, 210, 212, 214, 216, 218, 220, 222, 224, 226, 228, 230, and 232.

104. The method of clause 103, wherein the variant enzyme of threonine aldolase comprises an amino acid sequence of selected from the group consisting of SEQ ID NO:196, 206, 220, 224 and 232.

105. The method of any one of clauses 95-104, wherein the method comprises expressing a variant enzyme of gapA, wherein the variant enzyme of gapA comprises an amino acid sequence selected from the group consisting of SEQ ID NO: 69, 71, 73, 303, 294, 296, 233, 234, 235, 236, 298, and 300.

106. The method of any one of clauses 95-105, wherein the method comprises expressing a variant enzyme of gapA, wherein the variant enzyme of gapA comprises an amino acid sequence that shares at least 70% sequence identity to the amino acid sequence of SEQ ID NO:58.

107. The method of any one of clauses 95-105, wherein the method comprises expressing a variant enzyme of gapA, wherein the variant enzyme of gapA comprises an amino acid sequence that shares at least 70% sequence identity to an amino acid sequence selected from the group consisting of SEQ ID NO:294, 296, 233, 234, 235, 236, 298, and 300.

108. The method of clause 106 or 107, wherein the variant enzyme of gapA comprises an amino acid replacement in a position that corresponds to amino acid 37 of SEQ ID NO:58.

109. The method of clause 106 or 107, wherein the variant enzyme of gapA comprises amino acid replacements in positions that correspond to amino acids 36 and 37 of SEQ ID NO:58.

110. The method of clause 108 or 109, wherein the residue in the position of the variant enzyme of gapA that corresponds to amino acid 37 of SEQ ID NO:58 is lysine.

111. The method of clause 109, wherein the residue in the position of the variant enzyme of gapA that corresponds to amino acid 36 of SEQ ID NO:58 is by threonine, and the residue in the position of the variant enzyme of gapA that corresponds to amino acid 37 of SEQ ID NO:58 is lysine.

112. The method of any one of clauses 106-111, wherein the variant enzyme of gapA comprises an amino acid replacement in a position that corresponds to amino acid 192 of SEQ ID NO:58.

113. The method of clause 112, wherein the residue in the position of the variant enzyme of gapA that corresponds to amino acid 192 of SEQ ID NO:58 is serine.

114. The method of any one of clauses 106-113, wherein the residue in the position of the variant enzyme of gapA that corresponds to amino acid 224 of SEQ ID NO:58 is serine.

115. The method of any one of clauses 106-114, wherein the residue in the position of the variant enzyme of gapA that corresponds to amino acid 110 of SEQ ID NO:58 is aspartic acid.

116. The method of any one of clauses 106-115, wherein the residue in the position of the variant enzyme of gapA that corresponds to amino acid 140 of SEQ ID NO:58 is glycine.

117. The method of any one of clauses 95-105, wherein the method comprises expressing a variant enzyme of gapA, wherein the variant enzyme of gapA comprises an amino acid sequence identical to an amino acid sequence selected from the group consisting of SEQ ID NO:69, 71, 73, 303, 294, 296, 233, 234, 235, 236, 298, and 300.

Threonine Base Strain

118. A host cell comprising a multi-copy replicating plasmid comprising a thrA gene, a thrB gene, and a thrC gene each operatively linked to one or more synthetic promoters.

119. The host cell of clause 118, wherein the host cell is a tdh deletion (Δtdh) cell.

120. The host cell of clauses 118 or 119, wherein the multi-copy replicating plasmid comprises a sequence at least 70% identical to the thrABC operon sequence of SEQ ID NO:77.

Method of Improving Efficiency of Compound Production by Strategies Including Threonine Aldolase and Pyruvate Carboxylase 121. A method of improving efficiency of production of a compound by a host cell, comprising two or more of the following:
  (1) engineering the glycolytic pathway to produce NADPH by broadening the coenzyme specificity of the endogenous glycolytic enzyme Glyceraldehyde-3-phosphate dehydrogenase (gapA) such that the enzyme possesses dual specificity for NADP and NAD; (2) expressing a transhydrogenase enzyme in the host cell that generates NADPH from NADH; (3) reprogramming the DAP-pathway for lysine synthesis by expressing homologues of the endogenous gdh, asd, dapB and ddh enzymes, that use NADH more effectively than NADPH as a cofactor; (4) reprogramming the thrABC-pathway for threonine synthesis by expressing homologues of the endogenous gdh and asd enzymes, that use NADH more effectively than NADPH as a cofactor; (5) reprogramming threonine synthesis by expressing homologues of the endogenous L-threonine aldohase (ltA) that decrease or reverse degradation of threonine to glycine; and (6) expressing a heterologous pyruvate carboxylase (pyc) or homologues thereof to increase synthesis of oxaloacetate, or increasing expression of an endogenous pyc.

122. The method of clauses 121, wherein the engineering of the glycolytic pathway to produce NADPH by broadening the coenzyme specificity of the endogenous glycolytic enzyme Glyceraldehyde-3-phosphate dehydrogenase (gapA) such that the enzyme possesses dual specificity for NADP and NAD comprises expressing a variant enzyme of gapA comprising an amino acid sequence selected from the group consisting of SEQ ID NO:294, 296, 233, 234, 235, 236, 298, and 300.

123. The method of clause 121 or 122, wherein the reprogramming of the DAP-pathway for lysine synthesis by expressing homologues of the endogenous gdh, asd, dapB and ddh enzymes, that use NADH more effectively than NADPH as a cofactor comprises one or more of:
  i) expressing a variant enzyme of gdh comprising an amino acid sequence selected from the group consisting of SEQ ID NO:132, 134, 136, 138, 140, 142, 144, 146, 148, 150, 152, 154, 156, 158, 160, 162, 164, 166, 168, 170, 172, 174, 176, 178, 180, and 182;
  ii) expressing a variant enzyme of asd comprising an amino acid sequence selected from the group consisting of SEQ ID NO:80, 82, 84, 86, 88, 90, 92, 94, 96, 98, 100, 102, 104, 106, 108, 110, 112, 114, 116, 118, 120, 122, 124, 126, 128, and 130;
  iii) expressing a variant enzyme of dapB comprising an amino acid sequence selected from the group consisting of SEQ ID NO:46 and 48; and
  iv) expressing a variant enzyme of ddh comprising an amino acid sequence selected from the group consisting of SEQ ID NO: 2, 4, 6, 8, 10, 12, 14, 16, 18, and 20.

124. The method of any of clauses 121-123, wherein the reprogramming of the thrABC-pathway for threonine synthesis by expressing homologues of the endogenous gdh and asd enzymes, that use NADH more effectively than NADPH as a cofactor comprises one or more of:
  i) expressing a variant enzyme of gdh comprising an amino acid sequence selected from the group consisting of SEQ ID NO:132, 134, 136, 138, 140, 142, 144, 146, 148, 150, 152, 154, 156, 158, 160, 162, 164, 166, 168, 170, 172, 174, 176, 178, 180, and 182; and
  ii) expressing a variant enzyme of asd comprising an amino acid sequence selected from the group consisting of SEQ ID NO:80, 82, 84, 86, 88, 90, 92, 94, 96, 98, 100, 102, 104, 106, 108, 110, 112, 114, 116, 118, 120, 122, 124, 126, 128, and 130.

125. The method of any of clauses 121-124, wherein the reprogramming of threonine synthesis by expressing homologues of the endogenous L-threonine aldohase (ltA) that decrease or reverse degradation of threonine to glycine; comprises expressing a variant enzyme of ltA comprising an amino acid sequence selected from the group consisting of SEQ ID NO: 184, 186, 188, 190, 192, 194, 196, 198, 200, 202, 204, 206, 208, 210, 212, 214, 216, 218, 220, 222, 224, 226, 228, 230, and 232.

126. The method of any of clauses 121-125, wherein the expressing of a heterologous pyruvate carboxylase (pyc) or homologues thereof to increase synthesis of oxaloacetate, or increasing expression of an endogenous pyc comprises expressing a variant enzyme of pyc comprising an amino acid sequence selected from the group consisting of SEQ ID NO: 184, 186, 188, 190, 192, 194, 196, 198, 200, 202, 204, 206, 208, 210, 212, 214, 216, 218, 220, 222, 224, 226, 228, 230, and 232241, 243, 245, 247, 249, 251, 253, 255, 257, 259, 261, 263, 265, 267, 269, 271, 273, 275, 277, 279, 281, 283, 285, 287, and 289.

New gapA Variants—Polynucleotides

127. An artificial polynucleotide encoding a truncated glyceraldehyde-3-phosphate dehydrogenase (gapA) gene, wherein the polynucleotide comprises a sequence at least 85%, 90%, 95%, or 99% identical to a polynucleotide sequence selected from the group consisting of SEQ ID NO: 290, 291, 292, and 293.

128. The artificial polynucleotide of clause 127, wherein the polynucleotide comprises a polynucleotide sequence selected from the group consisting of SEQ ID NO: 290, 291, 292, and 293.

129. A vector comprising the artificial polynucleotide of clause 127 or 128 operatively linked to a promoter.

New gapA Variants—Proteins

130. A recombinant protein fragment of glyceraldehyde-3-phosphate dehydrogenase (gapA), wherein the recombinant protein fragment comprises a sequence at least 70%, 80%, 90%, or 95% identical to an amino acid sequence selected from the group consisting of SEQ ID NO: 233, 234, 235, 236, and 298.

131. The recombinant protein fragment of clause 130, wherein the recombinant protein fragment comprises an amino acid sequence selected from the group consisting of SEQ ID NO: 233, 234, 235, 236, and 298.

132. The recombinant protein fragment of clause 130 or 131, wherein the recombinant protein fragment lacks gapA activity.

133. The recombinant protein fragment of any one of clauses 130-133, wherein the recombinant protein frag- Other Embodiments 134. A method of improving a microbial cell's ability to produce a compound produced using NADPH, the method comprising altering the cell's available NADPH.

135. The method of claim 134, wherein the available NADPH is altered by expressing a modified Glyceraldehyde-3-phosphate dehydrogenase (GAPDH) in the cell, wherein the modified GAPDH is modified such that its coenzyme specificity is broadened.

136. The method of claim 134, wherein the cell's available NADPH is altered by expressing, in the microbial cell, a variant enzyme of one or more of the enzymes glutamate dehydrogenase (gdh), aspartate semialdehyde dehydrogenase (asd), dihydropicolinate reductase (dapB), and meso-diaminopimelate dehydrogenase (ddh), wherein the variant enzyme exhibits dual specificity for coenzymes NADH and NADPH.

137. The method of claim 135, wherein the modified GAPDH has an increased specificity to coenzyme NADP relative to the corresponding naturally occurring GAPDH.

138. The method of any one of claims 134-137, wherein the microbial cell is a bacterial cell.

139. The method of claim 138, wherein the bacterial cell is from a bacteria selected from the group consisting of *Corynebacterium* sp., *Escherichia* sp., *Bacillus* sp. or *Geobacillus* sp.

140. The method of claim 138, wherein the bacteria is *Corynebacterium glutamicum* or *Escherichia coli*.

141. The method of any one of claims 134-137, wherein the microbial cell is a yeast cell.

142. The method of claim 141, wherein the yeast cell is a cell from *Saccharomyces* sp.

143. The method of claim 137, wherein the naturally occurring GAPDH is gapA.

144. The method of claim 143, wherein the gapA has an amino acid sequence of SEQ ID NO:58.

145. The method of claim 134, wherein the modified GAPDH comprises an amino acid sequence that is at least 70% identical to the amino acid sequence of SEQ ID NO:58.

146. The method of claim 134, wherein the modified GAPDH comprises an amino acid sequence that is at least 70% identical to an amino acid sequence selected from the group consisting of SEQ ID NO:294, 296, 233, 234, 235, 236, 298, and 300.

147. The method of claim 145 or 146, wherein the modified GAPDH comprises an amino acid replacement in a position that corresponds to amino acid 37 of SEQ ID NO:58.

148. The method of claim 147, wherein the modified GAPDH comprises amino acid replacements in positions that correspond to amino acids 36 and 37 of SEQ ID NO:58.

149. The method of claim 147, wherein the threonine in the position that corresponds to amino acid 37 of SEQ ID NO:58 has been replaced by lysine.

150. The method of claim 148, wherein the leucine in the position that corresponds to amino acid 36 of SEQ ID NO:58 has been replaced by threonine, and the threonine in the position that corresponds to amino acid 37 of SEQ ID NO:58 has been replaced by lysine.

151. The method of claim 135, wherein the modified GAPDH comprises an amino acid replacement in a position that correspond to amino acid 192 of SEQ ID NO:58.

152. The method of claim 135, wherein the proline in the position that corresponds to amino acid 172 of SEQ ID NO:58 has been replaced by serine.

153. The method of claim 135, wherein the leucine in the position that corresponds to amino acid 224 of SEQ ID NO:58 has been replaced by serine.

154. The method of claim 135, wherein the histidine in the position that corresponds to amino acid 110 of SEQ ID NO:58 has been replaced by aspartic acid.

155. The method of claim 135, wherein the tyrosine in the position that corresponds to amino acid 140 of SEQ ID NO:58 has been replaced by glycine.

156. The method of claim 146, wherein the modified GAPDH is selected from the group consisting of SEQ ID NO:69, 71, 73, 303, 294, 296, 233, 234, 235, 236, 298, and 300.

157. The method of any one of claims 134-137, wherein the compound is selected from Table 2.

158. The method of claim 157, wherein the compound is L-lysine or L-threonine.

159. A microbial cell comprising a modified GAPDH having a broadened coenzyme specificity relative to a naturally existing GAPDH, wherein the microbial cell has improved production of a compound produced using NADPH relative to a counterpart microbial cell which lacks the modified GAPDH.

160. The microbial cell of claim 159, wherein the modified GAPDH has increased specificity to NADP relative to the naturally existing GAPDH.

161. The microbial cell of claim 160, wherein the modified GAPDH comprises an amino acid sequence which is at least 70% identical to SEQ ID NO: 58.

162. The microbial cell of claim 160, wherein the modified GAPDH comprises an amino acid sequence that is at least 70% identical to an amino acid sequence selected from the group consisting of SEQ ID NO:294, 296, 233, 234, 235, 236, 298, and 300.

163. The microbial cell of claim 160, wherein the modified GAPDH comprises an amino acid sequence which is at least 70% identical to SEQ ID NO: 58 and wherein the modified GAPDH comprises substitutions for the amino acids at positions 36, 37, or both of SEQ ID NO: 58.

164. The microbial cell of claim 160, wherein the modified GAPDH is selected from the group consisting of SEQ ID NO:69, 71, 73, 303, 294, 296, 233, 234, 235, 236, 298, and 300.

165. The microbial cell of claim 159, wherein the compound is selected from Table 2.

166. The microbial cell of claim 165, wherein the compound is L-lysine or L-threonine.

167. The microbial cell of claim 159, wherein the microbial cell is from bacteria.

168. The microbial cell of claim 167, wherein the bacteria is *Corynebacterium* sp., *Escherichia* sp., *Bacillus* sp. or *Geobacillus* sp 169. The microbial cell of claim 168, wherein the bacteria is *Corynebacterium glutamicum* or *Escherichia coli*.

170. The microbial cell of claim 165, wherein the microbial cell is a yeast cell.

171. A method of broadening the coenzyme specificity of GAPDH comprising: modifying the GAPDH such that the modified GAPDH has dual specificity for coenzymes NADP and NAD.

172. The method of claim 171, wherein the modified GAPDH has an increased specificity to coenzyme NADP relative to NAD.

173. The method of claim 172, wherein the modified GAPDH uses NADP more effectively than NAD.

174. The method of claim 136, wherein the method comprises expressing a variant enzyme of gdh, wherein the variant enzyme comprises an amino acid sequence that is at least 70% identical to the amino acid sequence of SEQ ID NO:42 or 44.

175. The method of claim 136, wherein the method comprises expressing a variant enzyme of asd, wherein the variant enzyme comprises an amino acid sequence that is at least 70% identical to the amino acid sequence of SEQ ID NO:30 or 40.

176. The method of claim 136, wherein the method comprises expressing a variant enzyme of dapB, wherein the variant enzyme comprises an amino acid sequence that is at least 70% identical to the amino acid sequence of SEQ ID NO:46 or 48.

177. The method of claim 136, wherein the method comprises expressing a ddh, wherein the ddh enzyme comprises an amino acid sequence of SEQ ID NO:4.

178. The method of claim 136, wherein the method comprises expressing a variant enzyme of gdh, wherein the variant enzyme comprises an amino acid sequence that is at least 70% identical to an amino acid sequence selected from the group consisting of SEQ ID NO: 132, 134, 136, 138, 140, 142, 144, 146, 148, 150, 152, 154, 156, 158, 160, 162, 164, 166, 168, 170, 172, 174, 176, 178, 180, and 182.

179. The method of claim 136, wherein the method comprises expressing a variant enzyme of asd, wherein the variant enzyme comprises an amino acid sequence that is at least 70% identical to an amino acid sequence selected from the group consisting of SEQ ID NO: 80, 82, 84, 86, 88, 90, 92, 94, 96, 98, 100, 102, 104, 106, 108, 110, 112, 114, 116, 118, 120, 122, 124, 126, 128, and 130.

180. The method of claim 136, wherein variants of all four enzymes are expressed simultaneously in the microbial cell.

181. A microbial cell comprising: a variant of one or more enzymes gdh, asd, dapB, and ddh, wherein the variant exhibits dual specificity for coenzymes NADH and NADPH.

182. The method of claim 178, wherein the variant enzyme of gdh comprises an amino acid sequence selected from the group consisting of SEQ ID NO:144, 150, 162, 166, 170, 174, 178.

183. The method of claim 179, wherein the variant enzyme of asd comprises an amino acid sequence of selected from the group consisting of SEQ ID NO:108 and 118.

184. The method of any one of claims 134-137 further comprising: expressing, in the microbial cell, a variant enzyme of threonine aldolase, wherein the variant enzyme of threonine aldolase exhibits substrate preference or enzyme kinetics different from *E. coli* threonine aldolase (ltaE).

185. The method of claim 184, wherein the variant threonine aldolase favors threonine production over glycine production.

186. The method of claim 184, wherein the variant threonine aldolase comprises an amino acid sequence that is at least 70% identical to an amino acid sequence selected from the group consisting of SEQ ID NO: 184, 186, 188, 190, 192, 194, 196, 198, 200, 202, 204, 206, 208, 210, 212, 214, 216, 218, 220, 222, 224, 226, 228, 230, and 232.

187. The method of claim 186, wherein the variant threonine aldolase comprises an amino acid sequence selected from the group consisting of SEQ ID NO:196, 206, 220, 224 and 232.

188. The method of claim 184, wherein the compound is L-threonine.

189. The method of claim 140, wherein the bacteria is *E. coli* and the method further comprises expressing a pyc in the *E. coli* cell.

190. The method of claim 189, wherein the method comprises expressing a variant enzyme of pyc, wherein the variant enzyme of pyc comprises an amino acid sequence at least 70% identical to an amino acid sequence selected from the group consisting of SEQ ID NO: 241, 243, 245, 247, 249, 251, 253, 255, 257, 259, 261, 263, 265, 267, 269, 271, 273, 275, 277, 279, 281, 283, 285, 287, and 289.

191. A microbial cell comprising a multi-copy replicating plasmid comprising a thrA gene, a thrB gene, and a thrC gene each operatively linked to one or more synthetic promoters.

192. The microbial cell of claim 191, wherein the microbial cell is a tdh deletion (Δtdh) cell.

193. The microbial cell of claim 191, wherein the multi-copy replicating plasmid comprises a sequence at least 70% identical to the thrABC operon sequence of SEQ ID NO:77.

194. A method of improving efficiency of production of a compound by a microbial cell, comprising two or more of the following:
(1) engineering the glycolytic pathway to produce NADPH by broadening the coenzyme specificity of the endogenous glycolytic enzyme Glyceraldehyde-3-phosphate dehydrogenase (gapA) such that the enzyme possesses dual specificity for NADP and NAD; (2) expressing a transhydrogenase enzyme in the bacteria that generates NADPH from NADH; (3) reprogramming the DAP-pathway for lysine synthesis by expressing homologues of the endogenous gdh, asd, dapB and ddh enzymes, that use NADH more effectively than NADPH as a cofactor; (4) reprogramming the thrABC-pathway for threonine synthesis by expressing homologues of the endogenous gdh and asd enzymes, that use NADH more effectively than NADPH as a cofactor; (5) reprogramming threonine synthesis by expressing homologues of the endogenous L-threonine aldohase (ltA) that decrease or reverse degradation of threonine to glycine; and (6) expressing a heterologous pyruvate carboxylase (pyc) or homologues thereof to increase synthesis of oxaloacetate, or increasing expression of an endogenous pyc.

195. The method of claim 194, wherein the compound is selected from Table 2.

196. The method of claim 195, wherein the compound is L-threonine.

197. The method of any of claims 194-196, wherein the engineering the glycolytic pathway to produce NADPH by broadening the coenzyme specificity of the endogenous glycolytic enzyme Glyceraldehyde-3-phosphate dehydrogenase (gapA) such that the enzyme possesses dual specificity for NADP and NAD comprises expressing a variant enzyme of gapA comprising an amino acid sequence selected from the group consisting of SEQ ID NO:294, 296, 233, 234, 235, 236, 298, and 300.

198. The method of any of claims 194-196, wherein the reprogramming the DAP-pathway for lysine synthesis by expressing homologues of the endogenous gdh, asd, dapB and ddh enzymes, that use NADH more effectively than NADPH as a cofactor comprises one or more of:
   i) expressing a variant enzyme of gdh comprising an amino acid sequence selected from the group consisting of SEQ ID NO:132, 134, 136, 138, 140, 142, 144, 146, 148, 150, 152, 154, 156, 158, 160, 162, 164, 166, 168, 170, 172, 174, 176, 178, 180, and 182;
   ii) expressing a variant enzyme of asd comprising an amino acid sequence selected from the group consisting of SEQ ID NO:80, 82, 84, 86, 88, 90, 92, 94, 96, 98, 100, 102, 104, 106, 108, 110, 112, 114, 116, 118, 120, 122, 124, 126, 128, and 130;
   iii) expressing a variant enzyme of dapB comprising an amino acid sequence selected from the group consisting of SEQ ID NO:46 and 48; and
   iv) expressing a variant enzyme of ddh comprising an amino acid sequence selected from the group consisting of SEQ ID NO: 2, 4, 6, 8, 10, 12, 14, 16, 18, and 20.

199. The method of any of claims 194-196, wherein the reprogramming the thrABC-pathway for threonine synthesis by expressing homologues of the endogenous gdh and asd enzymes, that use NADH more effectively than NADPH as a cofactor comprises one or more of:
   i) expressing a variant enzyme of gdh comprising an amino acid sequence selected from the group consisting of SEQ ID NO:132, 134, 136, 138, 140, 142, 144, 146, 148, 150, 152, 154, 156, 158, 160, 162, 164, 166, 168, 170, 172, 174, 176, 178, 180, and 182; and
   ii) expressing a variant enzyme of asd comprising an amino acid sequence selected from the group consisting of SEQ ID NO:80, 82, 84, 86, 88, 90, 92, 94, 96, 98, 100, 102, 104, 106, 108, 110, 112, 114, 116, 118, 120, 122, 124, 126, 128, and 130.

200. The method of any of claims 194-196, wherein the reprogramming threonine synthesis by expressing homologues of the endogenous L-threonine aldohase (ltA) that decrease or reverse degradation of threonine to glycine; comprises expressing a variant enzyme of ltA comprising an amino acid sequence selected from the group consisting of SEQ ID NO: 184, 186, 188, 190, 192, 194, 196, 198, 200, 202, 204, 206, 208, 210, 212, 214, 216, 218, 220, 222, 224, 226, 228, 230, and 232.

201. The method of any of claims 194-196, wherein the expressing a heterologous pyruvate carboxylase (pyc) or homologues thereof to increase synthesis of oxaloacetate, or increasing expression of an endogenous pyc comprises expressing a variant enzyme of pyc comprising an amino acid sequence selected from the group consisting of SEQ ID NO: 184, 186, 188, 190, 192, 194, 196, 198, 200, 202, 204, 206, 208, 210, 212, 214, 216, 218, 220, 222, 224, 226, 228, 230, and 232241, 243, 245, 247, 249, 251, 253, 255, 257, 259, 261, 263, 265, 267, 269, 271, 273, 275, 277, 279, 281, 283, 285, 287, and 289.

202. An artificial polynucleotide encoding a truncated glyceraldehyde-3-phosphate dehydrogenase (gapA) gene, wherein the polynucleotide comprises a sequence at least 70% identical to a polynucleotide sequence selected from the group consisting of SEQ ID NO: 290, 291, 292, and 293.

203. The artificial polynucleotide of claim 202, wherein the polynucleotide comprises a polynucleotide sequence selected from the group consisting of SEQ ID NO: 290, 291, 292, and 293.

204. A vector comprising the artificial polynucleotide of claim 202 or 203 operatively linked to a promoter.

205. A recombinant protein fragment of glyceraldehyde-3-phosphate dehydrogenase (gapA), wherein the recombinant protein fragment comprises a sequence at least 70% identical to an amino acid sequence selected from the group consisting of SEQ ID NO: 233, 234, 235, 236, and 298.

206. The recombinant protein fragment of claim 205, wherein the recombinant protein fragment comprises an amino acid sequence selected from the group consisting of SEQ ID NO: 233, 234, 235, 236, and 298.

207. The recombinant protein fragment of claim 205 or 206, wherein the recombinant protein fragment lacks gapA activity.

208. The recombinant protein fragment of claim 207, wherein the recombinant protein fragment enhances productivity of a compound selected from Table 2 by a microbial cell when the microbial cell comprises another protein having gapA activity.

209. The microbial cell of any one of claims 159-169, wherein the microbial cell further comprises a variant threonine aldolase, a pyc protein, or both.

INCORPORATION BY REFERENCE

All references, articles, publications, patents, patent publications, and patent applications cited herein are incorporated by reference in their entireties for all purposes.

However, mention of any reference, article, publication, patent, patent publication, and patent application cited herein is not, and should not be taken as an acknowledgment or any form of suggestion that they constitute valid prior art or form part of the common general knowledge in any country in the world. In particular, the following applications are hereby incorporated by reference in their entirety: U.S. application Ser. No. 15/396,230, filed on Dec. 30, 2016; International Application No. PCT/US2016/065465, filed on Dec. 7, 2016; U.S. application Ser. No. 15/140,296, filed on Apr. 27, 2016; U.S. Provisional Application No. 62/368,786, filed on Jul. 29, 2016; and U.S. Provisional Application No. 62/264,232, filed on Dec. 7, 2015.

SEQUENCE LISTING (308 sequences)

SEQ ID NO: 1 - DNA, 969 bp, Artificial Sequence
  codon optimized ddh from A. Oris
atgattcgcgttgcgatcaatggatatggcaacctgggacggggtgtcgaacaagcgattacgaagaacgcggacatggaagtcgcggtcgtgtttacgcgccgcgacccagctacggtgactacccagggcgcccccgtcgcccatgttgatgacatggccgcttgggccgataaagtggatgtctgtcttaactgcggcggatcagcgaccgacttgattgaacaaacgcccgctgcggcagctcttttcaacaccgtagattcgttcgatacgcatgcccggattcctgagcatttcgccgcggtggacgccgcagcgaaggcatcaggccatgtggcgttgatttcagcgggctgggacccaggacttttttccatgctccgggtcctcggcgaagcagtcctcccagacggtgctaccacgaccttctggggccccggagtttcgcagggtcattcagacgctctgcgtcgcatcgacggtgtggtagatgcgaaacaatacactcggccagtcgaggcaacggtggctgccgtcaaggcaggagatgatgttgagctcactacgcgctcaatgcacactcgtgactgctatgtagttgcggaggaaggcgcagatcttgcccggatcgagcgggagatcgttgagatgcccaattacttcgctgattacgatactaccgttactttcattactgccgaggaacttgccgcggagcacgcgggtattccgcatggaggatcggtaattcggcgtggccataccagcgaaggagtggccgaaaccgtgtcgtttgagctgcaattgggctctaaccccgaatttacgggatcagtcctggttgctacggcgcgtgctgtcgcacggcttgctgcccggggcgaaactggtgcccggacggtttttgacgttactcttgccgacttgtctccgactagccccgaggagctccgtgctcactacctg

SEQ ID NO: 2 - protein, 323 aa, Artificial Sequence
  codon optimized ddh from A. Oris
MIRVAINGYGNLGRGVEQAITKNADMEVAVVFTRRDPATVTTQGAPVAHVDDMAAWADKVDVCLNCGGSATDLIEQTPAAAALFNTVDSFDTHARIPEHFAAVDAAAKASGHVALISAGWDPGLFSMLRVLGEAVLPDGATTTFWGPGVSQGHSDALRRIDGVVDAKQYTRPVEATVAAVKAGDDVELTTRSMHTRDCYVVAEEGADLARIEREIVEMPNYFADYDTTVTFITAEELAAEHAGIPHGGSVIRRGHTSEGVAETVSFELQLGSNPEFTGSVLVATARAVARLAARGETGARTVFDVTLADLSPTSPEELRAHYL

SEQ ID NO: 3 - DNA, 960 bp, Artificial Sequence
  codon optimized ddh from C. glutamicum
atgacgaacatccgtgtagcaatcgtcggatacggtaatctgggacgcagcgtagaaaaactcatcgccaagcaaccagacatggatcttgttggaattttctcgcgccgggcgactctcgatacgaagacccccgtcttcgatgtggcggacgttgataaacatgccgatgatgtcgatgtactctttttgtgcatgggatctgcaacggatatcccggagcaagcccccaagttcgctcaatttgcctgtacggtggacacgtacgataatcatcgtgatatcccccggcatcgccaagttatgaatgaagctgcaaccgcagcaggcaatgtagcgttggtttctacgggctgggacccaggcatgttttcgattaatcgtgtttatgccgctgctgttttggccgagcaccagcaacacacgttttggggtccaggacttagccagggccatagcgatgcccttcgccgcatcccgggtgttcaaaaggctgttcagtacacgttgccttctgaagatgcgcttgaaaaagcacggcgcggcgaggccggagatttgaccggcaagcaaacgcataaacgccagtgcttcgttgtggccgacgcggccgaccatgagcgcatcgagaacgatattcggactatgcccgattacttcgtaggctatgaggtggaagtcaatttcatcgatgaagcaaccttcgactctgaacatacgggtatgccccacggcggtcacgtgatcacgactggcgacactggcggttttaaccacaccgttgagtatattctcaagctggaccgtaatcccgacttcactgcgtcctctcaaatcgcgttcggccgtgcagcgcaccgcatgaaacaacaaggccaatcaggtgcctttaccgttctggaagttgccccatatttgttgagcccggaaaacttggacgacttgattgcccgggatgtg

SEQ ID NO: 4 - protein, 320 aa, Artificial Sequence
  codon optimized ddh from C. glutamicum
MTNIRVAIVGYGNLGRSVEKLIAKQPDMDLVGIFSRRATLDTKTPVFDVADVDKHADDVDVLFLCMGSATDIPEQAPKFAQFACTVDTYDNHRDIPRHRQVMNEAATAAGNVALVSTGWDPGMFSINRVYAAAVLAEHQQHTFWGPGLSQGHSDALRRIPGVQKAVQYTLPSEDALEKARRGEAGDLTGKQTHKRQCFVVADAADHERIENDIRTMPDYFVGYEVEVNFIDEATFDSEHTGMPHGGHVITTGDTGGFNHTVEYILKLDRNPDFTASSQIAFGRAAHRMKQQGQSGAFTVLEVAPYLLSPENLDDLIARDV

SEQ ID NO: 5 - DNA, 993 bp, Artificial Sequence
  codon optimized ddh from H. archaeon
atgaaaaaaatcaacgtcggaattattggttacggtaacgtcggacggggtgtgaagcaagctctcgagaaaaacgcagacatgaaactggtcgctatcctgactcgtcgcccagagcgggtacggaaggaaatcaaagacgtgcatgttttccggactgatgaatcgttgccgaaatcctttgaaatcgacgtggcggtcttgtgtggtggatccaagaaagacatgccaatccaaggtccaaaatttgcggccaaatacaacaccgttgatagcttcgacacccatgccgacatccctagctatttcaagaaaatggattcaatcgctaaaaaacatggtaatgtgtctatcatctcagcgggatgggatcccggtattttcagcctggagcgtgtccttggcggcgcttttctgccggaatctaagcggtatacgttttggggcaagggtgtgtctctcggtcactctgatgctgctcgccgcgtgaaaggtgtctctgatgctattcaatacaccattccgattgagaaggctattcaacgcatccgtgcgggagatgcgccagactttagcaaaacggaaatgcacaagcgcgttgtttacgttgtccctgaagagggtgccgaccttaagaaaatccggaaggaaattaccgagatgccaaagtattttgaaggatatgatacggaggtcatttttatcactgagaaagaaatgaaaaaacactccacgtttccccacggcggctttgtcttcactagcggtgtaacgggagattctaaccgtcaaatcctcgaatataaatgccagctcgagaacaatagcgagttcactgcgtctgtccttgtagcgtgcgcacgcgctgcgtatcgtctgaatgagaaaggctaccgtggtgcttttacctttttggactttcccttgtcgtttcttatcgagtcggagtttagcgcgtgcttcgaaagccgcgcccggcgcaatccctctcct

SEQ ID NO: 6 - protein, 331 aa, Artificial Sequence
  codon optimized ddh from H. archaeon
MKKINVGIIGYGNVGRGVKQALEKNADMKLVAILTRRPERVRKEIKDVHVFRTDESLPKSFEIDVAVLCGGSKKDMPIQGPKFAAKYNTVDSFDTHADIPSYFKKMDSIAKKHGNVSIISAGWDPGIFSLERVLGGAFLPESKRYTFWGKGVSLGHSDAARRVKGVSDAIQYTIPIEKAIQRIRAGDAPDFSKTEMHKRVVYVVPEEGADLKKIRKEITEMPKYFEGYDTEVIFITEKEMKKHSTFPHGGFVFTSGVTGDSNRQILEYKCQLENNSEFTASVLVACARAAYRLNEKGYRGAFTFLDFPLSFLIESEFSACFESRARRNPSP

SEQ ID NO: 7 - DNA, 978 bp, Artificial Sequence
  codon optimized ddh from Coprobacillus sp.
atgatcaaaatcggcatcgtgggctacggaaacctgggacgtggtgtggaatgcgcggtccatcattcgcaggatatggaattggcgggagttttcacgcggcgcaatccggagacggttaaaactcacaccgacgttcctgtgtatgatatggagaaactgtacgacatgcagggcgacattgatgtcctcgtgctgtgcggaggctccgctaatgatctgccgaagcagacggttgagttggcacagtatttcaatgttgtagactctttcgatactcatgccaaaatccccgagcatttctctaatgttaatcaaagcagcgagaaaggtaaacatatttcgattatttcagtaggctgggatcctggattgttctccctcaatcggctgtatggacaagcaattctgccgaatggaaacgactacactttttggggtaaaggagtttcacagggacattctgatgcgatccggcgtatcgcaggcgttaaagacgcgcgccagtacacgatccccgtggacgccgcgttggagagcgttcgcaatggagaaaatccgaccctcaccactcgggagaagcacactcgggagtgtttcgttgtcgctgaagacggcgctgaccttaaagtgatcgaagaaacgatcaagaccatgccaaactattttgctgactatgacacgactgttcatttcatctcggaggaagagctgatgcgggatcatcaaggaattccgcatggtggcgtcgtacttcgcagcggaaccacgggctttgactatgagaacaagcacgtaatcgaatacaaactcactctggattcgaaccccgagttcacctcctctgttctcgttgcatatgctcgggccgcttatcgtatgcaccaagagggccaatgcggttgtaaaactgtatttgatattgccccggcataccttcacgttgaatccggagaggaattgcgtaagaaactcttg

SEQ ID NO: 8 - protein, 326 aa, Artificial Sequence
  codon optimized ddh from Coprobacillus sp.
MIKIGIVGYGNLGRGVECAVHHSQDMELAGVFTRRNPETVKTHTDVPVYDMEKLYDMQGDIDVLVLCGGSANDLPKQTVELAQYFNVVDSFDTHAKIPEHFSNVNQSSEKGKHISIISVGWDPGLFSLNRLYGQAILPNGNDYTFWGKGVSQGHSDAIRRIAGVKDARQYTIPVDAALESVRNGENPTLTTREKHTRECFVVAEDGADLKVIEETIKTMPNYFADYDTTVHFISEEELMRDHQGIPHGGVVLRSGTTGFDYENKHVIEYKLTLDSNPEFTSSVLVAYARAAYRMHQEGQCGCKTVFDIAPAYLHVESGEELRKKLL

SEQ ID NO: 9 - DNA, 981 bp, Artificial Sequence
  codon optimized ddh from M. harundinacea
atggaaaagctccgcattggcatcgtaggatacggaaatgttggccgggctgtggagctgtctcttcgccaaaacccggatatgatggccgcagtcgtcttgacccgccgtgacccccgtggtattcggacgctcacgcccggtttgatggcctcttcgattgaggaggctgaacggtacgcttcagaggtcgacgtggccgtactctgtggcggtagcgctacggaccttccagttcaaggaccggctatggcgtcaattttcaacactgtagattcctacgacaatcatccgcgcatcccagaatactttgcagcagtagattctgcggcacgccgtggccgtcggaccgcaatcgtgagcaccggttgggatcccggtctgttctcgttgatccgcctgcttgaggaggccgttttgcccgaaggcactgattatacgttttggggccctggagtgtcccaaggacattctgacgctgtacggcgggtcgaaggagtgcgtgatgcgcgccaatatactatccctatcgaggacaccgtggctcgcgtgcgttccggcgaggcaccctccctcagcacccgggaacgccatcttcgtcgttgctacgtggtggccgaagagggagccgaccccggtgagatccgtgagaaaattcggtcaatgcctaattattttgcagattatgataccaaggtctcgtttatttcgcaggaagagatggaacgcagccacaaccggatgccacatggtggtttcgttatgcgtgcgggaaagaccgccgacggaacgggtcacgtccttgagttccgtcttaaattggactctaaccccgctttcaccgcatccgtgttgttggcttatgcacgtgcagcatatcggctgcaccaagaaggcgcaattggcgcacggaccgtatttgatgtaccgccagcgcatctgtctcctaaaacgccagaggagattcgtcgttccatgctt

SEQ ID NO: 10 - protein, 327 aa, Artificial Sequence
  codon optimized ddh from M. harundinacea
MEKLRIGIVGYGNVGRAVELSLRQNPDMMAAVVLTRRDPRGIRTLTPGLMASSIEEAERYASEVDVAVLCGGSATDLPVQGPAMASIFNTVDSYDNHPRIPEYFAAVDSAARRGRRTAIVSTGWDPGLFSLIRLLEEAVLPEGTDYTFWGPGVSQGHSDAVRRVEGVRDARQYTIPIEDTVARVRSGEAPSLSTRERHLRRCYVVAEEGADPGEIREKIRSMPNYFADYDTKVSFISQEEMERSHNRMPHGGFVMRAGKTADGTGHVLEFRLKLDSNPAFTASVLLAYARAAYRLHQEGAIGARTVFDVPPAHLSPKTPEEIRRSML

SEQ ID NO: 11 - DNA, 972 bp, Artificial Sequence
  codon optimized ddh from M. micronuciformis
atggacaaaattcgcattggtatcgtgggatacggcaacctgggtcggggagcggaggcttcggtcaagctccagccggatatggagctgatcggtgttttctctcggcggaagggaattaagactgtgtcgggagtgcctgcatatactatggacgagatgctcaactttaagggtaaaatcgatgttatgattttgtgtggaggatcggcaacggacctgatcgaacagacccctgcggtggcagcccactttacctgtattgactcctttgatactcaccctcggattaccgaacactttaataacgtagataaagcggctaaagcagcaggtaccgccgccctgatttcatgtggttgggacccaggaatgttttctcttcaacgtgttttcgcggaagcaattttgccccaaggcaagtcttatacgttctggggccggggagtgtctcagggccattcggacgccattcggcggatcgatggagtcgtcgacgcgcggcagtatactgtaccaaaagataaatacctgaatgccatccgtaatggtgaaatgcccgaggtcactggacaggaggcgcatctgcgtgactgctacgttgtcgctgcggagggcgcagataaagctcggatcgagaacgaaattaagaccatgaaaaactattttgtgggatacgaaaccgtagtacacttcatttcacaggaggaactggaccgggatcacaagggcattccgcacggtggtttcgtacttcgcagcggcgagtcgacccccggtaccaaacatgtggtggaatatcgcctccagttggattccaacccggagtttactggttctgtgcttacggcgtatgctcgcggccttaaccgcttggctaagcataaagccaccggagctttcacggtgttcgatattcctcccgcgtggattagcgtacattctgacgaggagctgcgggcacactcactg

SEQ ID NO: 12 - protein, 324 aa, Artificial Sequence
  codon optimized ddh from M. micronuciformis
MDKIRIGIVGYGNLGRGAEASVKLQPDMELIGVFSRRKGIKTVSGVPAYTMDEMLNFKGKIDVMILCGGSATDLIEQTPAVAAHFTCIDSFDTHPRITEHFNNVDKAAKAAGTAALISCGWDPGMFSLQRVFAEAILPQGKSYTFWGRGVSQGHSDAIRRIDGVVDARQYTVPKDKYLNAIRNGEMPEVTGQEAHLRDCYVVAAEGADKARIENEIKTMKNYFVGYETVVHFISQEELDRDHKGIPHGGFVLRSGESTPGTKHVVEYRLQLDSNPEFTGSVLTAYARGLNRLAKHKATGAFTVFDIPPAWISVHSDEELRAHSL

SEQ ID NO: 13 - DNA, 1002 bp, Artificial Sequence
  codon optimized ddh from A. denitrificans
atgggtcttgataacaatgcacgcacggccatccgtatcggtatcgttggatacggcaaccttggacgtggtgtggaagcggcagtcgcccgcaattcggatatggcagttgccggaatttacacgcggcgtgaccctgcccaaattgaacccatgggcgcgggagtgccagtgcacgccatggactcgctccctggtcataaaggttcgattgatgttctggtactttgcggaggctcaaaagatgatctgccgcgccaatcccccgagttggccgctcactttagcctggttgattcctttgacacccatgctcggatcccagagcacttcgctgcggttgacgcggcggcgcaagcaggacgtacgacggcactgatttctgcaggttgggacccgggaatgttttccatcaatcgggtaatgggcgaggccctcttgccggatggcgccacctatacgttctggggcaagggactctcccagggccactctgatgcggtgcgtcgggttccgggcgtagctggcggtgtgcagtatactatccccgtggacgaagcggtagctcaggtacggtccggtttgcgtcctgccctcaccacgcgggaaaaacaccggcgcgaatgcttcgttgtactcgaagcgggagcagacgcctcggccgtgcgtaagacgattgttacgatgccccattattttgatgagtatgacaccactgtacactttatcggcgccgaggaattggctcgggaacacggcgccatgccgcacggcggatttgtcatccgctcaggtaatacctctcaggaaaacaaacaggtaatcgagtatcgtctccaactcgactctaaccctgaatttaccagctctgtcctcgtcgcatatgcacgtgccgtacatcgtatgcaacaggccggtcagtggggctgcaagacggtatttgatgttgcgccaggcctgctgtctccgcgctcggcggccgaactccgcgctcaacttctt

SEQ ID NO: 14 - protein, 334 aa, Artificial Sequence
  codon optimized ddh from A. denitrificans
MGLDNNARTAIRIGIVGYGNLGRGVEAAVARNSDMAVAGIYTRRDPAQIEPMGAGVPVHAMDSLPGHKGSIDVLVLCGGSKDDLPRQSPELAAHFSLVDSFDTHARIPEHFAAVDAAAQAGRTTALISAGWDPGMFSINRVMGEALLPDGATYTFWGKGLSQGHSDAVRRVPGVAGGVQYTIPVDEAVAQVRSGLRPALTTREKHRRECFVVLEAGADASAVRKTIVTMPHYFDEYDTTVHFIGAEELAREHGAMPHGGFVIRSGNTSQENKQVIEYRLQLDSNPEFTSSVLVAYARAVHRMQQAGQWGCKTVFDVAPGLLSPRSAAELRAQLL

SEQ ID NO: 15 - DNA, 957 bp, Artificial Sequence
  codon optimized ddh from M. luteus
atgaccattcgcgcgggaattgtaggatatggaaacctgggtcgctctgtagaaaaacttgttaaactgcagccggacatggaacttgttggcattttttcccggcggactggactcgacacggataccccagtacttcctgcggaacgtgcggccgagcacgcgggtgagattgatgtgctttttctgtgccttggaagcgcgactgatattccagagcaagcggccggttacgcacgccacttcacgaccgttgatacgtatgataaccatcaactgatcccacggcatcggtctgaaatggatgctgcggcccgggagggcggccacgtagcgatgatctcaactggatgggacccaggacttttttctgtcaatcgggtccttggagccgccctttttccgcagccccagcaaaatactttttggggcaagggcctctcacaaggtcactcggatgcagtgcggcgggtgccgggtgtacggcgtggcgttcagtacactattccgtcagaggaagcgattgcagaggcccgggctggtcgcggtgcagagattactggtgcgtcggctcatgttcgggagtgttacgtcgttgcagacgaggcagatcatgctgctatcactgaggcgatcaccaccatgccggattactttgccccctatgagacgaccgtacactttatttcggaggaagaatttgagcgggatcatcagggtatgccacacggaggccacgttgtcacgtctggtgacttgggaggctctcgctctgcggtagaatttgtcctcgaactcgaatctaatcctgactttaccgcagcagcccaggtagcctatggccgggccgccgctcgccttaaggcccagggtgagactggcgctcgtacggtacttgaggtcgctccctatcttctgtcaccgacgggtttggatgagctgattcgccgcgacgtg

SEQ ID NO: 16 - protein, 319 aa, Artificial Sequence
  codon optimized ddh from M. luteus
MTIRAGIVGYGNLGRSVEKLVKLQPDMELVGIFSRRTGLDTDTPVLPAERAAEHAGEIDVLFLCLGSATDIPEQAAGYARHFTTVDTYDNHQLIPRHRSEMDAAAREGGHVAMISTGWDPGLFSVNRVLGAALFPQPQQNTFWGKGLSQGHSDAVRRVPGVRRGVQYTIPSEEAIAEARAGRGAEITGASAHVRECYVVADEADHAAITEAITTMPDYFAPYETTVHFISEEEFERDHQGMPHGGHVVTSGDLGGSRSAVEFVLELESNPDFTAAAQVAYGRAAARLKAQGETGARTVLEVAPYLLSPTGLDELIRRDV

SEQ ID NO: 17 - DNA, 981 bp, Artificial Sequence
  codon optimized ddh from B. faecium
atgaccgttcatcgtattggcatcgtaggatatggaaacctcggacgtggagtagagatcgcgaccagcttgcaggaagacatgcaactcgttggtgtcttcacgcgccgcgacccttcaacggtaagcaccgttcatgctcagacgccagtacgctcaatcgacgcccttgaggagatgcaagacgaaattgatgtgctcgttctttgtggtggatcacgtaccgaccttcctgaacagacgccccagttggctgaacggtttactgtggttgattcgtttgacacccacgcgcggattcctgagcatttcgccaaagttgatgcagcggcgcgcgctgctggaaccaccgccctgatttccactggctgggatccaggcttgttttcgatcaatcgtgtatatggcgaagcaatccttgcgactggaactacctacaccttttggggtcggggactttcccagggccactccgatgctgtacggcgggtcgatggcgtagctgctgccgtacagtacactgtaccgagccaagaagcgattgctcgggtgcgggccggcgaacagcccacgctgtcgacgcgggaaaaacacacccgggaatgtttcgtcgttttggaggatggcgcggatgctgagactgtccgcgaggagatcgtaaccatgccccactattttgaaccttatgacactaccgtaaccttcctgtctgcagaggaactggcgcgcgatcaccagggcatgccgcacggcggttttgtgattcggtcaggagagtcaagcccaggcactacccagactattgaataccggcttcaggaagactctaacccggaatttactgcgtcggtccttgtcgcatatactcgtgctgccgcccggctcgcagccgccggcgaacatggtgctaagactcctttcgacgttgccccgggccttctgtccccgaagtcgcccgaacagctgcgcgccgagctcctg

SEQ ID NO: 18 - protein, 327 aa, Artificial Sequence
  codon optimized ddh from B. faecium
MTVHRIGIVGYGNLGRGVEIATSLQEDMQLVGVFTRRDPSTVSTVHAQTPVRSIDALEEMQDEIDVLVLCGGSRTDLPEQTPQLAERFTVVDSFDTHARIPEHFAKVDAAARAAGTTALISTGWDPGLFSINRVYGEAILATGTTYTFWGRGLSQGHSDAVRRVDGVAAAVQYTVPSQEAIARVRAGEQPTLSTREKHTRECFVVLEDGADAETVREEIVTMPHYFEPYDTTVTFLSAEELARDHQGMPHGGFVIRSGESSPGTTQTIEYRLQEDSNPEFTASVLVAYTRAAARLAAAGEHGAKTPFDVAPGLLSPKSPEQLRAELL

SEQ ID NO: 19 - DNA, 975 bp, Artificial Sequence
  codon optimized ddh from Carnobacterium sp.
atgactaacaagattcggattggtcttgtgggttacggtaacatcggaaagggcgtcgaattggcgctggaagagtttcctgacatggaaggcattgcggtcttcactcgtcggaatcccgaagatctcgattcaaagctcaaagctatctctttggaccacattcttgattaccaggaagatctggacgttttgatcctttgcggcggaagcgccaccgatttgcctggtcagggtcctgctcttgcaaagcatttctctacgattgactcctacgataatcacaatcaaattcctgaatatttcgaaactatggaccaatctgcaaaggcaggcaagaacatttcaattatctcggtcggctgggatccgggactgttctcactgaatcgggccgttttcgagtccatccttccggcgggagagacttacactttttggggcaaaggactgtcccagggccactccgacgccattcgtcggattgatggcgtcaagtttggcgttcaatacaccattcccgtcgaaaccgcactggaggaagtacggtctggatcgaatccgaccctttccactcgggagaagcacaaacgtgtgtgctacgttgtagcggaagcgggctccgaccagaatttgattgaggaaacgattaaaaccatgccggactacttcgagccgtacgacacgaccgtccatttcatcgacgagaaaacgttcaaggaggagcatcagaaaatgccacatggtggcttcgtgatccgtactgcaacttcagctacgggcaacaagcagaaagctgagttccagctcgaattggagtccaatgcagaattcacttcttcaatcctcgttgcgtacgctcgtgccgcctacaagtttaagaaagatggcaagtctggcgctctttcggtgctggatgtccctccggcatacctgtctccaaagtcggcagcgcagctccgcaaggagctcctg

SEQ ID NO: 20 - protein, 325 aa, Artificial Sequence
  codon optimized ddh from Carnobacterium sp.
MTNKIRIGLVGYGNIGKGVELALEEFPDMEGIAVFTRRNPEDLDSKLKAISLDHILDYQEDLDVLILCGGSATDLPGQGPALAKHFSTIDSYDNHNQIPEYFETMDQSAKAGKNISIISVGWDPGLFSLNRAVFESILPAGETYTFWGKGLSQGHSDAIRRIDGVKFGVQYTIPVETALEEVRSGSNPTLSTREKHKRVCYVVAEAGSDQNLIEETIKTMPDYFEPYDTTVHFIDEKTFKEEHQKMPHGGFVIRTATSATGNKQKAEFQLELESNAEFTSSILVAYARAAYKFKKDGKSGALSVLDVPPAYLSPKSAAQLRKELL

SEQ ID NO: 21 - DNA, 1062 bp, Artificial Sequence
  codon optimized asd from M. jannaschii
atgtccaagggagaaaaaatgaagatcaaggttggcgtattgggtgctaccggatcggttggccaacgctttgtgcagctgcttgcagaccaccccatgttcgaattgactgctctggcagcaagcgaacggtccgcgggtaaaaaatacaaagatgcttgttactggtttcaagatcgggacattccagaaaatattaaggatatggttgtaattccgacggatccgaagcacgaagaattcgaagacgttgatattgtttttagcgcgctgccctcggatctggctaaaaaattcgaacccgaattcgcgaaagaaggaaagctgatcttcagcaacgcatcagcctatcgtatggaggaagatgtgccgcttgtaattccagaggtaaacgctgatcacctcgaattgattgaaattcagcgcgagaagcggggttgggacggagccattatcactaacccaaactgttcaaccatttgcgccgtaatcacccttaagccaattatggacaaattcggtcttgaagcggtgtttatcgctaccatgcaggctgtatcgggcgcaggatacaacggtgtcccgagcatggctattctggataacttgattccctttattaagaatgaggaggagaagatgcagactgaatcgcttaagttgctgggcacgcttaaggatggaaaagtggaactcgctaacttcaaaatcagcgcatcatgcaatcgtgtggctgtgatcgacggccacaccgaatcgatcttcgtgaagaccaaggagggtgcggaacctgaggaaattaaagaagtgatggacaaatttgatcctcttaaagaccttaaccttccgacgtatgccaaaccaatcgtaattcgcgaagagatcgatcgcccacagccacgtcttgaccgcaatgagggtaatggcatgtctattgtcgttggtcgtatccgtaaagatccgatttttgatgttaagtacaccgccctggaacataacactatccgtggcgccgcgggcgcatcagtgttgaatgcggagtatttcgtaaagaaatacatc

SEQ ID NO: 22 - protein, 354 aa, Artificial Sequence
  codon optimized asd from M. jannaschii
MSKGEKMKIKVGVLGATGSVGQRFVQLLADHPMFELTALAASERSAGKKYKDACYWFQDRDIPENIKDMVVIPTDPKHEEFEDVDIVFSALPSDLAKKFEPEFAKEGKLIFSNASAYRMEEDVPLVIPEVNADHLELIEIQREKRGWDGAIITNPNCSTICAVITLKPIMDKFGLEAVFIATMQAVSGAGYNGVPSMAILDNLIPFIKNEEEKMQTESLKLLGTLKDGKVELANFKISASCNRVAVIDGHTESIFVKTKEGAEPEEIKEVMDKFDPLKDLNLPTYAKPIVIREEIDRPQPRLDRNEGNGMSIVVGRIRKDPIFDVKYTALEHNTIRGAAGASVLNAEYFVKKYI

SEQ ID NO: 23 - DNA, 1047 bp, Artificial Sequence
  codon optimized asd from S. usitatus
atgcagacgcggatcgaggtaggaattcttggagcgactggtatggtcggtcagcactttatcaaatttttgcaaggccacccttggttcgatctcaagtggctgggtgcttcagaccgctccgccggtaaacagtacaaagacgcgatgacctggcatcttgctggaggaaccccagattcagtcgctggtctcaccgtcgaagaatgcaaacccggcaatgccccccgtctgcttttcagcgctatggacgctggagttgcgaccgatattgaacgtgcgtttgcgcaggcgggtcatgtggttgtctcgaatagccgcaaccaccggatggagcaagacgttcctttgatggtgcctgagattaacccagatcatctgaagctggtaccgggacaacaacgcgcgcggggatggaaaggacagattgtcacgaacccgaattgctctacgatcggtctggtgatgggtctcggtccaatgaaacagttcggcattacgaagatccttgttaccacgatgcaggctatttcaggcgcaggatacccaggagtagcatccatggatattatgggtaacgttgtcccctacatcggctctgaagaggaaaagatggagatggaaactcaaaaaattatgggtgatttcgcgggcgatcgcatcgtgccgcttgcagcaaaggtctcggcccactgcaatcgggtaggcgttgttgacggccatacggaaactgtgtcagtcgaattctctatgaaaccaacggaggcagatttgcgccatgcgatcgaatcctttactgcagtgccccaggaacgcaagctcccgagcgcaccaggacgtccggttatctatatgaaggaagccaaccggccccaacctcgtaaggatgctgaacgggagcgtggcatggcagcgtttgttggtcgcctccgggcatgcccggtactggattataaatttgtggtcctgtcccacaatacgattcgcggcgcagcaggcgcagcagtcttgaatgccgaactcatgcactcagagggaatgttggat

SEQ ID NO: 24 - protein, 349 aa, Artificial Sequence
  codon optimized asd from S. usitatus
MQTRIEVGILGATGMVGQHFIKFLQGHPWFDLKWLGASDRSAGKQYKDAMTWHLAGGTPDSVAGLTVEECKPGNAPRLLFSAMDAGVATDIERAFAQAGHVVVSNSRNHRMEQDVPLMVPEINPDHLKLVPGQQRARGWKGQIVTNPNCSTIGLVMGLGPMKQFGITKILVTTMQAISGAGYPGVASMDIMGNVVPYIGSEEEKMEMETQKIMGDFAGDRIVPLAAKVSAHCNRVGVVDGHTETVSVEFSMKPTEADLRHAIESFTAVPQERKLPSAPGRPVIYMKEANRPQPRKDAERERGMAAFVGRLRACPVLDYKFVVLSHNTIRGAAGAAVLNAELMHSEGMLD

SEQ ID NO: 25 - DNA, 1032 bp, Artificial Sequence
  codon optimized asd from N. innermongolicus
atggcagtgcgggtaggtgtattgggcgctacgggagcagtgggtcaacggcttatccagctcctcgagcctcaccctgaattcgaaattgctgctctcaccgcgtcggagtcttccgctggtaaaacttatcgtcaggcggcgaaatggcgcgtagactccccaatccctgacgacgtcgcagagatgaccgtaagcgcaacggatcccgatgaggttccggatgacgtagatttgctgttcagcagcttgccgtcaagcgtcggcgaacaggtagagcccgctttttgcgaagccggatacgtgatgtcgtccaattcttctaatgctcgtatggcggatgacgtcccacttgttatcccagaggtaaatgctgaacatattgatcttcttgaggtccaacgcgatgaacgtggatgggatggcgcgatggtaaaaaaccctaattgttcaactattacctttgtcccaactcttgcggcccttgagcagtttggcctggaggaagtccacgttgcaacgctgcaagcggtgtccggtgcaggttatgatggagtctcctccatggagatcattgacaatgcaattccttatattggatcggaagaagagaaactggaaacggaatctcgtaagctcctgggagaatttgacggcgctgaactgtcgcataactcagttgaagtcgcagcttcgtgcaaccgtatcccgaccattgacggacacttggagaacgtgtgggttgagaccgaagacgaccttacgcccgaagatgccgcggatgcaatgcgcgcgtatccatcgttggagcttcgttcatctccggaccagctgattcatgtctttgatgaaccagaccgcccgcaaccgcggatggaccggactttgggagacggaatggcaatcgcggctggtggtttgcgtgaatcgactttcgaccttcaatacaattgcttggctcataacaccatccggggtgcagcgggagcctcggttctgaacggagagctgttgttggaccaaggttatatt

SEQ ID NO: 26 - protein, 344 aa, Artificial Sequence
  codon optimized asd from N. innermongolicus
MAVRVGVLGATGAVGQRLIQLLEPHPEFEIAALTASESSAGKTYRQAAKWRVDSPIPDDVAEMTVSATDPDEVPDDVDLLFSSLPSSVGEQVEPAFCEAGYVMSSNSSNARMADDVPLVIPEVNAEHIDLLEVQRDERGWDGAMVKNPNCSTITFVPTLAALEQFGLEEVHVATLQAVSGAGYDGVSSMEIIDNAIPYIGSEEEKLETESRKLLGEFDGAELSHNSVEVAASCNRIPTIDGHLENVWVETEDDLTPEDAADAMRAYPSLELRSSPDQLIHVFDEPDRPQPRMDRTLGDGMAIAAGGLRESTFDLQYNCLAHNTIRGAAGASVLNGELLLDQGYI

SEQ ID NO: 27 - DNA, 1047 bp, Artificial Sequence
  codon optimized asd from C. aurantiacus
atggccactattccagtcgccgttctgggtgccacgggtgccgtgggtcaacggttcattcagttgcttgagggtcacccgctttttcaggtagttgccctgactggcagcgagcgttccgctggtaaaaaataccacgaggtgtgtcgttgggttttggatactcctatgcccgcagcggttgcaaacctgacggtactggatgcagacgcagacctccccgcacagctcgtgttctccgcgctcccgtctaccgtcgccggcccgatcgaacaacgtcttgctgctgctggtcatatcgtgtgctccaacgcttcgaaccatcgtatggagccagatgtgccactcattattcccgaagtcaacccggaccatcttgccttgattcccgttcaacgccgccgccgtggttggtccggtgctattgttaccaacccaaactgcacttccacgccggcgacgatggtgttgcgccctttgctcgatacctttggagtccggcgcatgcttttggtgtcaatgcaagccctctctggagccggctacccaggtgtgccctcatacgatgtagttgataacgtgatcccctacatcggtggagaagaaccaaaactcgagattgagccgcagaaaatgctgggacgtctggaaggagaaacgattgttccagcaggcttcacgacttccgcacactgcaatcgggtccctgtgctcgaaggccacctggtttgtctctcgatcgagcttgaacggaaagccgaccctgccgagatcgcgacggtgctcagcaatttccgtgcactccctcaggaattgcggctgccgactgcgccagagcagcctatcattgtacgtcacgaacccgaccgtcctcaaccgcgccgcgaccgtgatgctggacggggaatggccaccgtagtaggtcgcattcggccctgcagcctttttgacattaagttgatcgcattgtcacataacaccatccggggcgccgccggagcgagcatcctgaacgccgagcttatgcatgcccaaggttggctggcg

SEQ ID NO: 28 - protein, 349 aa, Artificial Sequence
  codon optimized asd from C. aurantiacus
MATIPVAVLGATGAVGQRFIQLLEGHPLFQVVALTGSERSAGKKYHEVCRWVLDTPMPAAVANLTVLDADADLPAQLVFSALPSTVAGPIEQRLAAAGHIVCSNASNHRMEPDVPLIIPEVNPDHLALIPVQRRRRGWSGAIVTNPNCTSTPATMVLRPLLDTFGVRRMLLVSMQALSGAGYPGVPSYDVVDNVIPYIGGEEPKLEIEPQKMLGRLEGETIVPAGFTTSAHCNRVPVLEGHLVCLSIELERKADPAEIATVLSNFRALPQELRLPTAPEQPIIVRHEPDRPQPRRDRDAGRGMATVVGRIRPCSLFDIKLIALSHNTIRGAAGASILNAELMHAQGWLA

SEQ ID NO: 29 - DNA, 1089 bp, Artificial Sequence
  codon optimized asd from L. agilis
atggatgaaaaactccgtgccggtgttctgggcgccacgggtatggtaggacagcggttcgtagcgatgttggagaatcacccgtggttcgaagtaaccactcttgcagcttcgccgcgctcagcaggtaaaacgtacgcacaggctgtggatggccggtggaaaatggaaactcccattccagaggccgtcaaggatctcaagattcttgatgtatcggaagttgagaaagtcgcagctcaagtcgattttgtgttttccgcagtttctatgtccaaagacaagattaaagcgattgaagaagcctacgcgaaaaccgaaactccggtagtatcgaacaattcggcgcaccgttggaccccagatgttcctatggtcgtgcccgaaattaacccggagcatttcaaggtaattgattaccagcggaaacggctcggcacgaagcgcggcttcattgccgttaagccgaactgttctatccagagctacgccccggctctcagcgcatggttgaaattcgaaccgtacgaggtaatcgcttcaacttatcaggctatctcgggagctggtaagaacttcgacgactggccggagatgaagggaaacatcatcccttttatttctggcgaggaggaaaaatcagagaaggagcccctcaagatctggggacaacttgacgaagctaagggagagatcgtcccagccactagccctgttattacgagccaatgtattcgggtcccgatcctttacggacacaccgcgaccgtctttgttaaattcaagcagaacccaacgaaagaggaactggtagctgctttggaatcatatcagggactgcctcaatccttgaatttgccgtctacccctaagcaatttattcagtatctcagcgaagacgaccgtccgcaggttgcgaaggacgttaactttgagaatggtatgggtatctctattggccgccttcgtaaagattcggtttacgattggaagttcgtaggactctcgcacaacaccgcgcgtggcgccgcaggaggcggcgtcctttcggccgaattgctgacggctcagggctatattaccaaaaag

SEQ ID NO: 30 - protein, 363 aa, Artificial Sequence
  codon optimized asd from L. agilis
MDEKLRAGVLGATGMVGQRFVAMLENHPWFEVTTLAASPRSAGKTYAQAVDGRWKMETPIPEAVKDLKILDVSEVEKVAAQVDFVFSAVSMSKDKIKAIEEAYAKTETPVVSNNSAHRWTPDVPMVVPEINPEHFKVIDYQRKRLGTKRGFIAVKPNCSIQSYAPALSAWLKFEPYEVIASTYQAISGAGKNFDDWPEMKGNIIPFISGEEEKSEKEPLKIWGQLDEAKGEIVPATSPVITSQCIRVPILYGHTATVFVKFKQNPTKEELVAALESYQGLPQSLNLPSTPKQFIQYLSEDDRPQVAKDVNFENGMGISIGRLRKDSVYDWKFVGLSHNTARGAAGGGVLSAELLTAQGYITKK

SEQ ID NO: 31 - DNA, 1092 bp, Artificial Sequence
  codon optimized asd from B. pullorum
atgtccgagaaactgaaggtaggaattattggagcgaccggcatggtgggtcagcggttcgtgactctgttggataatcacccatggtttgaggtcaccaccttggctgcctcagcacactcggccggaaaaacctacgagcaggccgttggtggccggtggaagatggagacgcctatgccggcggcggtgaaggacatgattgtccgggatgccaaggatgtggagagcgtggctgcagacgtggacttcgtgttctctgcagtgaacatgccgaaggacgagatccgtgccttggaggagcgctacgccaagacggagactcccgttgtatcaaacaactcggcccaccgttggacgccagacgtacccatggtagtccccgagattaatcccgaacattatgaagtaatcaagtaccagcgggctcgtcttggtactacgcgtggcttcatcgccgtgaaaccaaactgctccatccaggcatatacgccggcactcgccgcgtggcgggagttcgaaccgcgtgaagtcgtggtatctacttaccaagcgatttctggtgctggtaagactttcgcggactggccagaaatggaaggcaatatcatccctttcattagcggtgaagaggagaagtccgagcgggaaccactgcgggtatttggccacgtcgatgagagcaagggtcagattgtcccctttgatggtccactccgtatcacgtcgcagtgtatccgtgtacccgtattgaatggtcacactgctactgtttttatcaacttcggcaaaaaaccatctaaggatgaactcatcgaccgtcttgtgaactacacgtcggaggcgagccgtcttggtctccctcacgctcccaaacagttcatccaatatctgactgaggatgatcgtccgcaggtacgtttggacgttgattacgagggcggtatgggagtttccatcggtcgcctgcgcgaggacacgctcttcgacttcaaattcgtgggactcgctcataacacgctgcgtggagccgcaggtggagcacttgaatccgcagaaatgttgaaagcactcggatatatttcggcgaaa

SEQ ID NO: 32 - protein, 364 aa, Artificial Sequence
  codon optimized asd from B. pullorum
MSEKLKVGIIGATGMVGQRFVTLLDNHPWFEVTTLAASAHSAGKTYEQAVGGRWKMETPMPAAVKDMIVRDAKDVESVAADVDFVFSAVNMPKDEIRALEERYAKTETPVVSNNSAHRWTPDVPMVVPEINPEHYEVIKYQRARLGTTRGFIAVKPNCSIQAYTPALAAWREFEPREVVVSTYQAISGAGKTFADWPEMEGNIIPFISGEEEKSEREPLRVFGHVDESKGQIVPFDGPLRITSQCIRVPVLNGHTATVFINFGKKPSKDELIDRLVNYTSEASRLGLPHAPKQFIQYLTEDDRPQVRLDVDYEGGMGVSIGRLREDTLFDFKFVGLAHNTLRGAAGGALESAEMLKALGYISAK

SEQ ID NO: 33 - DNA, 1059 bp, Artificial Sequence
  codon optimized asd from B. bacterium
atgaagcaattcaatgtgggaattttgggagcaacgggtgcagttggccagaaattcatcaatctcctccagggtcatccttggttcacgattacggctctcggagcatccgaacgttccgcgggaaaatcctacgctgaagcagttaattggattgaagccgttgagttgcctgacgcaattgcctctatgacggtcactgattgctctcccgcaagcatgaaaggcgttgatttcgtgttttctggtttggacgcgtctgtagcgaccgaacttgagggcgatctcgctcgggctggtattcccgtgatctcaaatgctaagaactatcgcactcacccgcatgtcccccttctggtaccagaggtgaacgcgacccacaccgagatgattaaggcacaagattttgatccttccggccgtggctttatcgtaacgaatccaaattgtgtcgcggttcctctcgtgatggcgctcaagcctctcatggacgcgtacggtatccaggcagtcgccctcacgactatgcaatcggtgtctggtgctggttaccccggagtcgcctctttggacatcctgggaaatgtgatcccatttatttccggcgaggagccgaaaatcgccgcggagcctatgaaattgttgggccggctgggaggagaccaaaccgtcaccgaggcccgtttccctattgacgctaccgcaactcgtgtgcctaccatcgagggacatcttttgagcgtgaagattaagttcgaacaaaagccagcgtctgctgacgaaattaaggctgtgctccgtaactggaagcacgaggtttcaggtttggatcttccgtcttctccgcgtactgcgctcaaagtttacgatgacgatcggtttccacaaccacgcaaaaacgcttacaacgagaacggaatgcaagtcggcgtgggtcgtgtgcgtatgctcgagttttttgacgcgggtcttgttgcattgggccataatacgtgtcggggtgcggctggcgtagctatcttgaacgctgagctgctggtaaaacagggtttcatccaa

SEQ ID NO: 34 - protein, 353 aa, Artificial Sequence
  codon optimized asd from B. bacterium
MKQFNVGILGATGAVGQKFINLLQGHPWFTITALGASERSAGKSYAEAVNWIEAVELPDAIASMTVTDCSPASMKGVDFVFSGLDASVATELEGDLARAGIPVISNAKNYRTHPHVPLLVPEVNATHTEMIKAQDFDPSGRGFIVTNPNCVAVPLVMALKPLMDAYGIQAVALTTMQSVSGAGYPGVASLDILGNVIPFISGEEPKIAAEPMKLLGRLGGDQTVTEARFPIDATATRVPTIEGHLLSVKIKFEQKPASADEIKAVLRNWKHEVSGLDLPSSPRTALKVYDDDRFPQPRKNAYNENGMQVGVGRVRMLEFFDAGLVALGHNTCRGAAGVAILNAELLVKQGFIQ

SEQ ID NO: 35 - DNA, 1086 bp, Artificial Sequence
  codon optimized asd from M. hansupus
atggctcgtttgcgtgctgcgttgatcggcgcgacgggactcgccggtcaacagttcattgcggccctcaaagaccacccttttattgaattgactggactggcagcgtcgccacggtcggcgggcaaaacgtacgctgaagccctcaagactgcatcaggtatgactgcatggttcgtaccagaacccctgccagccggcattgctggtatgaaagttgttgcgggagacgccctcgaggcgaaagattatgaccttgttttctctgctgtagaagcggacgtagcccgcgagcttgagccaaaactggcgaaagacattccagtattttcggctgctagcgcgttccgctacgaagatgacgtaccactgcttatcccccccgttaacgccgcacacgcgcctctgattcgtgaacagcagcgtcgtcgtggttggaaaggttatgttgttccaatcccaaattgcacgaccaccggccttgcggttacgctcgcgcctcttgtcgagcggtttggagtcaaggctgtcttgatgacctcacttcaagcaatgagcggagcgggacggtctcctggcgtgatcggcatggacattcttgataacgtgattccgtatatccccaaagaggaacataaagtagaagtggagactaagaaaattcttggtgctcttcgtcctggtggcgaaggccttacgccccacgatatccgcgtctcatgcacctgcactcgggtcgcggtcatggaaggccatactgaatcagtttttgtttctctggaaaaaaaagctactgttgcagaggttacccaagcgttgcgtgaatggcagggcgcggaacttgcacggaaattgccgtccgccgcaccgcgttggattgaagtgcttgatgaccccttccgcccacaaccgcgtcttgaccgggacacgcacggtggaatggctaccacggtgggtcggattcgtgaggacggtgttttggagaacggatttaagtacgttttggtttctcacaacactaaaatgggagctgctcgcggcgcgattttggtagcagaactgcttcgggctcaaggcttgcttgga

SEQ ID NO: 36 - protein, 362 aa, Artificial Sequence
  codon optimized asd from M. hansupus
MARLRAALIGATGLAGQQFIAALKDHPFIELTGLAASPRSAGKTYAEALKTASGMTAWFVPEPLPAGIAGMKVVAGDALEAKDYDLVFSAVEADVARELEPKLAKDIPVFSAASAFRYEDDVPLLIPPVNAAHAPLIREQQRRRGWKGYVVPIPNCTTTGLAVTLAPLVERFGVKAVLMTSLQAMSGAGRSPGVIGMDILDNVIPYIPKEEHKVEVETKKILGALRPGGEGLTPHDIRVSCTCTRVAVMEGHTESVFVSLEKKATVAEVTQALREWQGAELARKLPSAAPRWIEVLDDPFRPQPRLDRDTHGGMATTVGRIREDGVLENGFKYVLVSHNTKMGAARGAILVAELLRAQGLLG

SEQ ID NO: 37 - DNA, 1083 bp, Artificial Sequence
  codon optimized asd from P. sabinae
atgacggagaaattgcgtgctggcatcgtcggcggaactggaatggtcggccagcgctttattgcgcttcttgagaatcacccttggtttcaggtaaccgctattgccgctagcgccaactctgcgggtaaaacgtatgaggaatccgtaaaaggccggtggaagctctctacgccaatgcctgaaagcgtcaagcacattccagtgcaggacgcgtcacgtgtcgaggaagtagccgcaggcgtggatttgatcttttgcgcggtcgatatgaaaaagaatgaaatccaggcactcgaggaagcctatgccaaagcgggtgtccccgtcatcagcaacaactccgcacatcggtggactccagacgttccgatggtcgttccagaaatcaacccagaacacctggaggtcattgcagctcagcggaaacgcctgggaaccgaaactggcttcattgcggtaaagcctaattgcagcatccagtcttatgttccaatgctgaacgcacttcggggctttaagcctactcaagttgtcgcatccacttatcaggcgatttctggtgccggtaaaacgttcacggattggcccgaaatgctggacaacgtaatcccttacattggaggtgaggaggaaaaaagcgaacaagagccgcttcgcatttggggtactgtagaggatggccaaattgttaaagcctccgcaccccatattacgacgcaatgcatccgggtaccagtgactgacggtcacctggccactgttttcgttagcttcgagaataaaccctcaaaggaagacattctcgaatcctggaaaaattacaagggtcggccgcaagagcttgaacttccgtcagcacccaaacaattcatcacttacttcgaagaggaaaatcggccacagaccaacctcgaccgcgacatcgaaaatggaatgggcatttccgctggccgcctccgggaggatagcctttatgactttaaattcgttggactctcacataacactctgcgcggagctgctggtggtgcggtactgatcgcagagttgctcaaggcagagggctacattactaagcgc

SEQ ID NO: 38 - protein, 361 aa, Artificial Sequence
  codon optimized asd from P. sabinae
MTEKLRAGIVGGTGMVGQRFIALLENHPWFQVTAIAASANSAGKTYEESVKGRWKLSTPMPESVKHIPVQDASRVEEVAAGVDLIFCAVDMKKNEIQALEEAYAKAGVPVISNNSAHRWTPDVPMVVPEINPEHLEVIAAQRKRLGTETGFIAVKPNCSIQSYVPMLNALRGFKPTQVVASTYQAISGAGKTFTDWPEMLDNVIPYIGGEEEKSEQEPLRIWGTVEDGQIVKASAPHITTQCIRVPVTDGHLATVFVSFENKPSKEDILESWKNYKGRPQELELPSAPKQFITYFEEENRPQTNLDRDIENGMGISAGRLREDSLYDFKFVGLSHNTLRGAAGGAVLIAELLKAEGYITKR

SEQ ID NO: 39 - DNA, 1032 bp, Artificial Sequence
  codon optimized asd from  C. glutamicum
atgaccactatcgcggtcgttggagcaacgggacaagtaggacaggtgatgcggacgcttctggaagaacgtaattttcctgccgatacggtccggttctttgcgtcgccgcggagcgccggtcggaagatcgagttccggggtaccgaaattgaggtagaggacatcacccaagcgaccgaggagtctctcaaagatattgatgtagcacttttttctgcaggcggtaccgcgtcgaagcaatatgctcctctgttcgcggctgcgggtgcgacggtggtggacaattcttcggcctggcggaaagatgatgaagtaccgttgattgtctctgaagtaaatccttcggacaaagattctctcgtgaagggtatcattgcgaaccctaactgtaccaccatggctgcaatgcctgtactgaaaccacttcatgatgccgcaggtcttgtaaagcttcatgtctcctcgtatcaagcggtatccggtagcggtctcgcaggcgtcgaaaccctcgcaaaacaggtcgctgctgttggtgaccataacgtcgagttcgtccacgacggtcaggccgccgacgcaggagatgttggcccatacgtcagccccatcgcttataatgttttgcccttcgcaggtaacctggttgacgacggaacctttgagaccgacgaggagcaaaaactgcgcaatgaaagccgtaagatcctcggactgccggacttgaaagtttccggtacgtgtgtacgtgttcccgtgtttactggacataccttgactatccatgctgagttcgataaagcaattaccgtggaccaagctcaggagatcctcggagcagcgtcgggagtaaagttggtagacgtaccgactcctctggcggctgcgggtattgatgagtcgcttgtaggacgcattcgccaagactcgacggtggatgacaaccgcggactcgttctcgtggtatctggcgacaatcttcggaagggcgcggctttgaataccatccagatcgccgagcttctggtaaag

SEQ ID NO: 40 - protein, 344 aa, Artificial Sequence
  codon optimized asd from C. glutamicum
MTTIAVVGATGQVGQVMRTLLEERNFPADTVRFFASPRSAGRKIEFRGTEIEVEDITQATEESLKDIDVALFSAGGTASKQYAPLFAAAGATVVDNSSAWRKDDEVPLIVSEVNPSDKDSLVKGIIANPNCTTMAAMPVLKPLHDAAGLVKLHVSSYQAVSGSGLAGVETLAKQVAAVGDHNVEFVHDGQAADAGDVGPYVSPIAYNVLPFAGNLVDDGTFETDEEQKLRNESRKILGLPDLKVSGTCVRVPVFTGHTLTIHAEFDKAITVDQAQEILGAASGVKLVDVPTPLAAAGIDESLVGRIRQDSTVDDNRGLVLVVSGDNLRKGAALNTIQIAELLVK

SEQ ID NO: 41 - DNA, 1341 bp, Artificial Sequence
  codon optimized gdh from C. glutamicum
atgactgtagatgaacaggtttctaactactacgacatgcttctcaaacgtaatgctggagagcccgaatttcatcaggcggttgctgaagtgcttgaatccctcaagattgttcttgaaaaagatccgcactacgcggactatggcctcatccagcggctgtgtgaacctgaacgtcaactgatcttccgtgtgccgtgggtagatgatcagggacaagtgcacgtcaaccgcggttttcgtgtacagtttaattcggcgctcggtccctacaaaggcggattgcgtttccaccctagcgtcaatcttggcatcgtcaagtttttgggtttcgaacaaatttttaagaattcccttaccggactgcctatcggaggcggaaagggcggttcggattttgaccctaaaggcaagagcgatctcgaaatcatgcggttttgtcagtcttttatgaccgaactgcatcgtcacatcggcgaatatcgcgatgtcccggcgggtgatatcggcgtgggtggtcgtgagatcggatacctctttggtcattatcgtcggatggcgaatcagcacgaatcgggagtccttaccggcaaaggtctgacttggggcggcagcctggttcggaccgaagccacgggatacggttgtgtctatttcgtatcggagatgatcaaagcaaaaggcgagtcaatctcgggacagaagattatcgtatccggatcgggaaatgttgctacctatgccattgagaaagctcaagagctgggcgcgacggtgatcggcttctcggattcctcaggctgggtgcatactccgaatggtgtggacgtggctaaacttcgcgaaatcaaggaagtacgtcgcgcacgcgtaagcgtttatgccgatgaagtggagggagcaacctaccataccgatggatccatctgggatcttaagtgtgacatcgcacttccttgcgctacgcaaaatgaactgaacggagagaatgcgaaaacgctggccgataatggttgccgcttcgtcgcggagggcgctaacatgccgagcaccccggaggccgtcgaagtttttcgggagcgcgacatccggttcggccccggcaaagcggctaatgctggcggagtggcaacgtcagcgttggagatgcagcagaacgcatcccgggactcatggagcttcgaatacaccgacgaacgcctccaggtcattatgaagaacatttttaagacgtgtgcggaaaccgcagccgagtatggccacgagaacgattacgtcgtcggagcaaacattgcaggatttaagaaagttgctgatgcgatgctcgcccaaggtgtgatc

SEQ ID NO: 42 - protein, 447 aa, Artificial Sequence
  codon optimized gdh from C. glutamicum
MTVDEQVSNYYDMLLKRNAGEPEFHQAVAEVLESLKIVLEKDPHYADYGLIQRLCEPERQLIFRVPWVDDQGQVHVNRGFRVQFNSALGPYKGGLRFHPSVNLGIVKFLGFEQIFKNSLTGLPIGGGKGGSDFDPKGKSDLEIMRFCQSFMTELHRHIGEYRDVPAGDIGVGGREIGYLFGHYRRMANQHESGVLTGKGLTWGGSLVRTEATGYGCVYFVSEMIKAKGESISGQKIIVSGSGNVATYAIEKAQELGATVIGFSDSSGWVHTPNGVDVAKLREIKEVRRARVSVYADEVEGATYHTDGSIWDLKCDIALPCATQNELNGENAKTLADNGCRFVAEGANMPSTPEAVEVFRERDIRFGPGKAANAGGVATSALEMQQNASRDSWSFEYTDERLQVIMKNIFKTCAETAAEYGHENDYVVGANIAGFKKVADAMLAQGVI

SEQ ID NO: 43 - DNA, 1350 bp, Artificial Sequence
  codon optimized gdh from C. symbiosum
atgtccaagtacgttgaccgcgtcattgctgaagtcgagaaaaagtacgccgacgaaccggaattcgttcaaaccgttgaagaggtactctcttcactcggcccagtagtcgacgcacaccccgagtatgaagaggttgcgctcttggagcgtatggtcattccagaacgtgtcattgagtttcgcgtcccgtgggaggatgacaatggtaaagtacatgtgaatactggttaccgcgtccaatttaatggcgcgatcggcccttataaaggtggcttgcgcttcgccccttcggtcaacctttccattatgaaatttctcggcttcgagcaagcattcaaagattccctgaccacgcttcctatgggaggagcaaaaggcggttcagacttcgacccaaacggaaaatccgatcgcgaagtaatgcgcttctgccaggcgttcatgactgagttgtatcggcatattggtcccgatatcgacgtgcctgctggtgacttgggcgttggtgcgcgtgaaattggttacatgtacggacaataccggaagatcgtcggcggattctacaatggcgtcctgaccggtaaagcccggtcattcggtggaagcttggtccggcccgaagcaactggttacggatcggtgtattatgtggaggctgtgatgaaacatgaaaatgacacgcttgtaggtaaaactgttgcactggcaggttttggtaacgttgcatggggtgcagctaagaagctcgcggagttgggtgcgaaagcagtaactttgtctggcccggatggctatatctacgaccccgagggtatcactaccgaggaaaagatcaattacatgcttgaaatgcgggcgtctggacgtaacaaggtacaggattacgcagacaagtttggagtgcaattctttccgggtgaaaagccttggggccaaaaagttgacattattatgccttgtgcaactcagaatgatgttgacctggaacaggctaaaaagatcgtggcgaacaacgtgaagtactacatcgaagtagccaacatgcctactactaatgaagcattgcggtttcttatgcagcaacctaacatggtagtcgcccccagcaaggctgtgaacgcaggtggagtactggtatcgggtttcgagatgtcacaaaattccgaacgtctgtcatggaccgccgaagaagtcgatagcaaactgcatcaggtgatgactgacattcatgacggttcagccgccgcagctgaacgctacggacttggttacaatcttgtcgcaggtgctaatatcgtaggttttcagaagatcgccgatgccatgatggctcaaggaatcgcttgg

SEQ ID NO: 44 - protein, 450 aa, Artificial Sequence
  codon optimized gdh from C. symbiosum
MSKYVDRVIAEVEKKYADEPEFVQTVEEVLSSLGPVVDAHPEYEEVALLERMVIPERVIEFRVPWEDDNGKVHVNTGYRVQFNGAIGPYKGGLRFAPSVNLSIMKFLGFEQAFKDSLTTLPMGGAKGGSDFDPNGKSDREVMRFCQAFMTELYRHIGPDIDVPAGDLGVGAREIGYMYGQYRKIVGGFYNGVLTGKARSFGGSLVRPEATGYGSVYYVEAVMKHENDTLVGKTVALAGFGNVAWGAAKKLAELGAKAVTLSGPDGYIYDPEGITTEEKINYMLEMRASGRNKVQDYADKFGVQFFPGEKPWGQKVDIIMPCATQNDVDLEQAKKIVANNVKYYIEVANMPTTNEALRFLMQQPNMVVAPSKAVNAGGVLVSGFEMSQNSERLSWTAEEVDSKLHQVMTDIHDGSAAAAERYGLGYNLVAGANIVGFQKIADAMMAQGIAW

SEQ ID NO: 45 - DNA, 744 bp, Artificial Sequence
  codon optimized dapB from C. glutamicum
atgggcattaaagttggagtgctgggagctaagggccgggtaggtcagacgatcgtggcagcagtgaacgaatcagacgatctcgagttggtagcagaaatcggtgtggatgacgatctgtctctgctcgtagacaacggcgcggaggtcgttgttgacttcactacgcctaatgcggtgatgggaaacttggagttctgtatcaacaacggaatctccgcagtagtaggaaccaccggatttgatgatgcacgcctcgaacaagtacgggactggctggaaggtaaggacaacgtcggagtcttgattgcccctaactttgcgatttcagcagtgcttaccatggtgttctctaaacaggcggcgcgctttttcgaatccgcagaagttatcgaacttcaccacccgaataaacttgacgccccttctggcactgcgattcatactgctcaaggtattgcagcggctcgtaaagaggcaggtatggatgcacagcccgatgcaactgagcaagcccttgagggtagccgtggcgcgtctgttgatggtattccggtacatgccgttcgcatgtcaggcatggtcgcacatgaacaagtaatctttggcacgcaaggccaaacgcttactattaaacaagatagctacgatcgtaactctttcgcgccgggtgttttggttggagtccgcaatatcgcacagcatcccggattggtggttggccttgagcattaccttggattg

SEQ ID NO: 46 - protein, 248 aa, Artificial Sequence
  codon optimized dapB from C. glutamicum
MGIKVGVLGAKGRVGQTIVAAVNESDDLELVAEIGVDDDLSLLVDNGAEVVVDFTTPNAVMGNLEFCINNGISAVVGTTGFDDARLEQVRDWLEGKDNVGVLIAPNFAISAVLTMVFSKQAARFFESAEVIELHHPNKLDAPSGTAIHTAQGIAAARKEAGMDAQPDATEQALEGSRGASVDGIPVHAVRMSGMVAHEQVIFGTQGQTLTIKQDSYDRNSFAPGVLVGVRNIAQHPGLVVGLEHYLGL

SEQ ID NO: 47 - DNA, 819 bp, Artificial Sequence
  codon optimized dapB from E. coli
atgcacgacgcaaacattcgggtcgccattgcgggagctggaggacgtatgggacgccagctcatccaggcggcgcttgccctcgaaggcgtgcaattgggagcagctctggaacgcgagggctcttcactcttgggctctgatgccggcgagctggctggtgccggcaaaacgggcgtaacggtccagtcttctctcgacgccgtaaaggatgattttgatgtgtttattgactttacgcgcccggagggaactctgaaccatctggcattctgccggcagcatggtaagggcatggttatcggaaccaccggatttgatgaggctggaaaacaggcgattcgggatgccgctgccgatattgctatcgtattcgcagcaaacttcagcgtaggcgttaacgttatgctcaaactgctggagaaggcagctaaggtgatgggtgactatacggacattgagattattgaagctcatcatcgtcacaaagtagacgctccttcaggaaccgcgctggcaatgggcgaagcaattgctcatgcgttggacaaagacctcaaagactgcgcggtgtattcacgggagggacatactggtgaacgtgttcctggtacgattggttttgccaccgtccgtgcaggcgacattgtgggagaacatacggccatgttcgcagacatcggtgaacgtcttgagatcacccacaaggctagctcgcggatgacgttcgcaaacggagcggttcggtccgccctgtggctgtctggcaaagaatctggactcttcgacatgcgggacgtgttggaccttaacaatttg

SEQ ID NO: 48 - protein, 273 aa, Artificial Sequence
  codon optimized dapB from E. coli
MHDANIRVAIAGAGGRMGRQLIQAALALEGVQLGAALEREGSSLLGSDAGELAGAGKTGVTVQSSLDAVKDDFDVFIDFTRPEGTLNHLAFCRQHGKGMVIGTTGFDEAGKQAIRDAAADIAIVFAANFSVGVNVMLKLLEKAAKVMGDYTDIEIIEAHHRHKVDAPSGTALAMGEAIAHALDKDLKDCAVYSREGHTGERVPGTIGFATVRAGDIVGEHTAMFADIGERLEITHKASSRMTFANGAVRSALWLSGKESGLFDMRDVLDLNNL

SEQ ID NO: 49 - DNA, 1266 bp, Artificial Sequence
  codon optimized aspK from C. glutamicum
atggccctggtcgtacagaaatatggcggttcctcgcttgagagtgcggaacgcattagaaacgtcgctgaacggatcgttgccaccaagaaggctggaaatgatgtcgtggttgtctgctccgcaatgggagacaccacggatgaacttctagaacttgcagcggcagtgaatcccgttccgccagctcgtgaaatggatatgctcctgactgctggtgagcgtatttctaacgctctcgtcgccatggctattgagtcccttggcgcagaagctcaatctttcactggctctcaggctggtgtgctcaccaccgagcgccacggaaacgcacgcattgttgacgtcacaccgggtcgtgtgcgtgaagcactcgatgagggcaagatctgcattgttgctggttttcagggtgttaataaagaaacccgcgatgtcaccacgttgggtcgtggtggttctgacaccactgcagttgcgttggcagctgctttgaacgctgatgtgtgtgagatttactcggacgttgacggtgtgtataccgctgacccgcgcatcgttcctaatgcacagaagctggaaaagctcagcttcgaagaaatgctggaacttgctgctgttggctccaagattttggtgctgcgcagtgttgaatacgctcgtgcattcaatgtgccacttcgcgtacgctcgtcttatagtaatgatcccggcactttgattgccggctctatggaggatattcctgtggaagaagcagtccttaccggtgtcgcaaccgacaagtccgaagccaaagtaaccgttctgggtatttccgataagccaggcgagactgccaaggttttccgtgcgttggctgatgcagaaatcaacattgacatggttctgcagaacgtcttctctgtggaagacggcaccaccgacatcacgttcacctgccctcgcgctgacggacgccgtgcgatggagatcttgaagaagcttcaggttcagggcaactggaccaatgtgctttacgacgaccaggtcggcaaagtctccctcgtgggtgctggcatgaagtctcacccaggtgttaccgcagagttcatggaagctctgcgcgatgtcaacgtgaacatcgaattgatttccacctctgagatccgcatttccgtgctgatccgtgaagatgatctggatgctgctgcacgtgcattgcatgagcagttccagctgggcggcgaagacgaagccgtcgtttatgcaggcaccggacgctaa

SEQ ID NO: 50 - protein, 421 aa, Artificial Sequence
  codon optimized aspK from C. glutamicum
MALVVQKYGGSSLESAERIRNVAERIVATKKAGNDVVVVCSAMGDTTDELLELAAAVNPVPPAREMDMLLTAGERISNALVAMAIESLGAEAQSFTGSQAGVLTTERHGNARIVDVTPGRVREALDEGKICIVAGFQGVNKETRDVTTLGRGGSDTTAVALAAALNADVCEIYSDVDGVYTADPRIVPNAQKLEKLSFEEMLELAAVGSKILVLRSVEYARAFNVPLRVRSSYSNDPGTLIAGSMEDIPVEEAVLTGVATDKSEAKVTVLGISDKPGETAKVFRALADAEINIDMVLQNVFSVEDGTTDITFTCPRADGRRAMEILKKLQVQGNWTNVLYDDQVGKVSLVGAGMKSHPGVTAEFMEALRDVNVNIELISTSEIRISVLIREDDLDAAARALHEQFQLGGEDEAVVYAGTGR

SEQ ID NO: 51 - DNA, 9972 bp, Artificial Sequence
  Plasmid Backbone Sequence
gtctgctcacaaatctcagcgaccgcattgatgaaggaaatcttggtggccaagaacgcattcgcggaaactttcaccagctcagcggtagcaagatcagtgaccaaaaacggcgtatcagcagcaatcgcggtggcgtaaacctcccgagcgatcgcctctgctgtcgccacctcacgcacacccaccacgatgcggtccggagtgatggtgtctttgaccgcgtagccctcacgcaagaactccggattccacgcgatctccacgtgcgaaccaggcttgaccagagaatcagcaagctcctgcaactgctcagcggtaccaaccggaaccgtagacttgccgaaaataatgtgctcgccctcaagcagcggcaccaaatcctcaacaacctgacgaacatacgtcagatccgccgcataagtacccttctgctgaggagtacccacgcccaagaaatgcacctgcgcgaaagccgcagcctccgcataaccagtagtgaagttcaggcgaccattttccagattgcgctccaaaacctcaggcaaacccggctcaaaaaatgggaccttgctgtccttcaacgacgcaatctttacctcatcgacatcgacaccaagaacctcatggccaagctcagccatgcaggccgcgtgcgtagcgccaaggtaacccgtaccaatcactgtcatccgcatgtagggtgattcctttcaatgaagagtggactggagattatctcaacacgttttgatacagcccgcgaccggaacacatgattgcttacttgttggggaaattcaggtacgccttcgaaggagtaggaccacgctgcccctgatacttcgaaccaagcttgccggaaccatacggagtctccgcaggggaactcatctggaacaaagccaactgccccaccttcatacccggccacaacgtgatcggcagattagccacattggacaactccaacgtgatgtaaccgctaaaaccaggatcaatgaaaccagcagtagagtgcgtcaacagtccaagacgaccaagagacgacttgccctccaaacgaccagccagatgcgcaggcaaagtgaacttttccagcgtggacgccagcacaaactcacccggatgcagcacaaagccctcgccgtcctcaacctcaacaaggctggtcagctcatcctgattcaacttagggtcaatgtgggtgtacttagagttattgaaaacccggaagtagcggtccatgcggacatcgacactcgacggctgaatcagctcagcgtcgaaaggttcaattcccaagtcgcctgcgtcaattgatttacgaatgtcacgatctgaaagaagcacgtcaaccagtgtagcgttcagcgttcagggttgggccacgggttgctgcgatgaggttcctggggcgcgtggtgctgtcgctgatttttatcgtgctagccttattctcggcccttaattaagcgccaccttttacactgccggtgtagttcaatggtagaactcctgcttcccaagcaggcggcgcgggttcgattcccgtcaccggctccaaataagcccctgacctctcaatacgcaatgaaggtcaagggcttaattctatggaaactacaaaaagtacccacttaaatacacgctttaaatcccctcacgatgcgatcatcagcccttttacatttttagaaaaagctttgcagttttccatcgcagccgaaaaccgctccagtgcgaaattgcacactacatcacaccgaacactcgacgacatctttaattttcaacatatccccacccccagaaattattcaccacttacacttcacatactcaccaatgcataacccaaaaagcgttagatgaaactccccacccgaatccacaagaactcgggtgccctcagtttcacatacccctaagcgcaacactgtgcgagctttccgccagtaggccaagcaccctttcgattaaccccgacaaacttttaaggcaagcctaaattaggtaaaccttaaacagtcgccattgaagaaattgatgccgtttctcgcgttgtgtgtggtactacgtggggacctaagcgtgtattatggaaacgtctgtatcggataagtagcgaggagtgttcgttaaaaatggccctggtcgtacagaaatatggcggttcctcgcttgagagtgcggaacgcattagaaacgtcgctgaacggatcgttgccaccaagaaggctggaaatgatgtcgtggttgtctgctccgcaatgggagacaccacggatgaacttctagaacttgcagcggcagtgaatcccgttccgccagctcgtgaaatggatatgctcctgactgctggtgagcgtatttctaacgctctcgtcgccatggctattgagtcccttggcgcagaagctcaatctttcactggctctcaggctggtgtgctcaccaccgagcgccacggaaacgcacgcattgttgacgtcacaccgggtcgtgtgcgtgaagcactcgatgagggcaagatctgcattgttgctggttttcagggtgttaataaagaaacccgcgatgtcaccacgttgggtcgtggtggttctgacaccactgcagttgcgttggcagctgctttgaacgctgatgtgtgtgagatttactcggacgttgacggtgtgtataccgctgacccgcgcatcgttcctaatgcacagaagctggaaaagctcagcttcgaagaaatgctggaacttgctgctgttggctccaagattttggtgctgcgcagtgttgaatacgctcgtgcattcaatgtgccacttcgcgtacgctcgtcttatagtaatgatcccggcactttgattgccggctctatggaggatattcctgtggaagaagcagtccttaccggtgtcgcaaccgacaagtccgaagccaaagtaaccgttctgggtatttccgataagccaggcgagactgccaaggttttccgtgcgttggctgatgcagaaatcaacattgacatggttctgcagaacgtctcctctgtggaagacggcaccaccgacatcttgttcacctgccctcgcgctgacggacgccgtgcgatggagatcttgaagaagcttcaggttcagggcaactggaccaatgtgctttacgacgaccaggtcggcaaagtctccctcgtgggtgctggcatgaagtctcacccaggtgttaccgcagagttcatggaagctctgcgcgatgtcaacgtgaacatcgaattgatttccacctctgagatccgcatttccgtgctgatccgtgaagatgatctggatgctgctgcacgtgcattgcatgagcagttccagctgggcggcgaagacgaagccgtcgtttatgcaggcaccggacgctaatagagttttaaaggagtagttttacaatgtccaagggagaaaaaatgaagatcaaggttggcgtattgggtgctaccggatcggttggccaacgctttgtgcagctgcttgcagaccaccccatgttcgaattgactgctctggcagcaagcgaacggtccgcgggtaaaaaatacaaagatgcttgttactggtttcaagatcgggacattccagaaaatattaaggatatggttgtaattccgacggatccgaagcacgaagaattcgaagacgttgatattgtttttagcgcgctgccctcggatctggctaaaaaattcgaacccgaattcgcgaaagaaggaaagctgatcttcagcaacgcatcagcctatcgtatggaggaagatgtgccgcttgtaattccagaggtaaacgctgatcacctcgaattgattgaaattcagcgcgagaagcggggttgggacggagccattatcactaacccaaactgttcaaccatttgcgccgtaatcacccttaagccaattatggacaaattcggtcttgaagcggtgtttatcgctaccatgcaggctgtatcgggcgcaggatacaacggtgtcccgagcatggctattctggataacttgattccctttattaagaatgaggaggagaagatgcagactgaatcgcttaagttgctgggcacgcttaaggatggaaaagtggaactcgctaacttcaaaatcagcgcatcatgcaatcgtgtggctgtgatcgacggccacaccgaatcgatcttcgtgaagaccaaggagggtgcggaacctgaggaaattaaagaagtgatggacaaatttgatcctcttaaagaccttaaccttccgacgtatgccaaaccaatcgtaattcgcgaagagatcgatcgcccacagccacgtcttgaccgcaatgagggtaatggcatgtctattgtcgttggtcgtatccgtaaagatccgatttttgatgttaagtacaccgccctggaacataacactatccgtggcgccgcgggcgcatcagtgttgaatgcggagtatttcgtaaagaaatacatctaggcatttttagtacgtgcaataaccactctggtttttccagggtggttttttgatgccctttttggagtcttcaactgcttagctttgacctgcacaaatagttgcaaattgtcccacatacacataaagtagcttgcgtatttaaaattatgaacctaaggggtttagcaatgactgtagatgaacaggtttctaactactacgacatgcttctcaaacgtaatgctggagagcccgaatttcatcaggcggttgctgaagtgcttgaatccctcaagattgttcttgaaaaagatccgcactacgcggactatggcctcatccagcggctgtgtgaacctgaacgtcaactgatcttccgtgtgccgtgggtagatgatcagggacaagtgcacgtcaaccgcggttttcgtgtacagtttaattcggcgctcggtccctacaaaggcggattgcgtttccaccctagcgtcaatcttggcatcgtcaagtttttgggtttcgaacaaatttttaagaattcccttaccggactgcctatcggaggcggaaagggcggttcggattttgaccctaaaggcaagagcgatctcgaaatcatgcggttttgtcagtcttttatgaccgaactgcatcgtcacatcggcgaatatcgcgatgtcccggcgggtgatatcggcgtgggtggtcgtgagatcggatacctctttggtcattatcgtcggatggcgaatcagcacgaatcgggagtccttaccggcaaaggtctgacttggggcggcagcctggttcggaccgaagccacgggatacggttgtgtctatttcgtatcggagatgatcaaagcaaaaggcgagtcaatctcgggacagaagattatcgtatccggatcgggaaatgttgctacctatgccattgagaaagctcaagagctgggcgcgacggtgatcggcttctcggattcctcaggctgggtgcatactccgaatggtgtggacgtggctaaacttcgcgaaatcaaggaagtacgtcgcgcacgcgtaagcgtttatgccgatgaagtggagggagcaacctaccataccgatggatccatctgggatcttaagtgtgacatcgcacttccttgcgctacgcaaaatgaactgaacggagagaatgcgaaaacgctggccgataatggttgccgcttcgtcgcggagggcgctaacatgccgagcaccccggaggccgtcgaagtttttcgggagcgcgacatccggttcggccccggcaaagcggctaatgctggcggagtggcaacgtcagcgttggagatgcagcagaacgcatcccgggactcatggagcttcgaatacaccgacgaacgcctccaggtcattatgaagaacatttttaagacgtgtgcggaaaccgcagccgagtatggccacgagaacgattacgtcgtcggagcaaacattgcaggatttaagaaagttgctgatgcgatgctcgcccaaggtgtgatctaggcttttcgacgtctcctccggcgaaacccaaaaaaggaaccctcacagttcgtgagggttccttttactattgtctacaatccaaggtaatgctcaaggccaaccaccaatccgggatgctgtgcgatattgcggactccaaccaaaacacccggcgcgaaagagttacgatcgtagctatcttgtttaatagtaagcgtttggccttgcgtgccaaagattacttgttcatgtgcgaccatgcctgacatgcgaacggcatgtaccggaataccatcaacagacgcgccacggctaccctcaagggcttgctcagttgcatcgggctgtgcatccatacctgcctctttacgagccgctgcaataccttgagcagtatgaatcgcagtgccagaaggggcgtcaagtttattcgggtggtgaagttcgataacttctgcggattcgaaaaagcgcgccgcctgtttagagaacaccatggtaagcactgctgaaatcgcaaagttaggggcaatcaagactccgacgttgtccttaccttccagccagtcccgtacttgttcgaggcgtgcatcatcaaatccggtggttcctactactgcggagattccgttgttgatacagaactccaagtttcccatcaccgcattaggcgtagtgaagtcaacaacgacctccgcgccgttgtctacgagcagagacagatcgtcatccacaccgatttctgctaccaactcgagatcgtctgattcgttcactgctgccacgatcgtctgacctacccggcccttagctcccagcactccaactttaatgcccattgtaaaactactcctttaaaactctacacatcccgggcaatcaagtcgtccaagttttccgggctcaacaaatatggggcaacttccagaacggtaaaggcacctgattggccttgttgtttcatgcggtgcgctgcacggccgaacgcgatttgagaggacgcagtgaagtcgggattacggtccagcttgagaatatactcaacggtgtggttaaaaccgccagtgtcgccagtcgtgatcacgtgaccgccgtggggcatacccgtatgttcagagtcgaaggttgcttcatcgatgaaattgacttccacctcatagcctacgaagtaatcgggcatagtccgaatatcgttctcgatgcgctcatggtcggccgcgtcggccacaacgaagcactggcgtttatgcgtttgcttgccggtcaaatctccggcctcgccgcgccgtgctttttcaagcgcatcttcagaaggcaacgtgtactgaacagccttttgaacacccgggatgcggcgaagggcatcgctatggccctggctaagtcctggaccccaaaacgtgtgttgctggtgctcggccaaaacagcagcggcataaacacgattaatcgaaaacatgcctgggtcccagcccgtagaaaccaacgctacattgcctgctgcggttgcagcttcattcataacttggcgatgccgggggatatcacgatgattatcgtacgtgtccaccgtacaggcaaattgagcgaacttgggggcttgctccgggatatccgttgcagatcccatgcacaaaaagagtacatcgacatcatcggcatgtttatcaacgtccgccacatcgaagacgggggtcttcgtatcgagagtcgcccggcgcgagaaaattccaacaagatccatgtctggttgcttggcgatgagtttttctacgctgcgtcccagattaccgtatccgacgattgctacacggatgttcgtcatttttaacgaacactcctcgctacttatccgatacagacgtttccataatacacgcttaggtccccacgtagtaccacacacaacgcgagaaacggcaagaattttaaaaacaaacaaccttcaacgcgctaacaagcatcttcccactctcgttaccggagtttctcacatgtctcacaagttttcccgccgcgctttcgcagtactgaccgctgccgcgatttccacttccgctttcgcaaccactgctccgtctgcgattgcagaaccagtttccatagtcaccaccgcagacgattctagcgtcgcaacttcagaaaactcccttgactggggtttcaagtcttcctggcgcacctatgtcaccggaccttggactggtggaaccgttgacgcaactggcggtgcaactgtcaacgaagatggaacctacaacttcaccctcggaactggctccacttacgacatcgacaccgagaagggccagctgaactacgaaggaactgttgccttcgccagtgacgctcacggcttcaacatcaccttgtccaacccgcagatcaccgtcgagggcgacactgcaactttgagcgccgagctgtctgacaatgccgctccagaagagacctccactactcgcgttgatgtcgctgagttcgagctgactgctcctgcggtttcagaaaccgatgcaaacaccacttacacttggatcgatgtttccggcactttcctagaatccctgccgcctgaagaattgagccgttacgcaggccaggaagcggatgcgctgagcttctccatcaccgtggacaaggcttcagagaacccttccgatgatgttgctaccggatcttcctccagcttcctctccaccatcttgaacttccttcagcagctggcgagcccactactcaagctcttcggttcgctttcttcctaaataatcagtaatgccccaccagatctggtggggcattttgttttaggagcagaccacgtttggtgaaggatcgtaaaccgtggtgacggtttctctggtgatttcgttgccagaaagatcgctgatgattcgggtgtcggaggtggtaaatcctggtgcaccggttgatggcacacaatctgaacccgatactcgaactgtgttgggctgggtggtggaccaacgtccgttgttgatggattccacggaggtggtgtccacacccatgatgcgcacggtcacgtttgaggcgtcggcagaggtgctgatcatgacggggtatggggagttgttgcggaattgaaggtcgatggcaccatcgaaaatagtagcttcacgtccggctgggtagcgggaaatgtagtagctgtgcggggtgtgcgtgatgtcttccagacctgcgaagtagtacgcgttgtacaaggtggtggcgaactgactgatgccaccgccgactgcggtgtcggaacgaccattcaaaatgatgccggaatcaacaaagccttgggctgcgccacgtgggccggtgtagttgttgagggagaacgtatcgccaggtgaaacgactgcgccgtcgaccatttgcgcggtgaggcggatgtttgttccggaggcagcagagaagccgccggtggtgaactcgcccatgacctcattgaaggtagcgttttgggcgtcggtggcggtgaatgttgctggggtgtcctcatagacagcgtcgatggtgcgggggccatcgccggtgaggttgttgggcagatcggccagggtttcttcccagttgattccgtgtccggtgacttctggggtgactacgcgggagcctgaggagaaactgatttgagcgttggtgggctcgatctctgtttctttgaggccttcggccagcattgctgtggctgcttctgcattgatgtcgacgcggatggtgccgttttcttctgggaaactcaccacttcacccatgcgctcgacggggatggtgccttcaattccgtcatcgcctcggacgacgaaggggctagatacggctttagctccggcgccttctgcaagttcatcgatggtgtcttggctgatcgcagcgggaacaacgtatggctcggcttctacgccctctgggttgagccagttttctgtgactgcttgttccaaaacggtgcgg

SEQ ID NO: 52 - DNA, 97 bp, Artificial Sequence
  Promoter Sequence
tgccgtttctcgcgttgtgtgtggtactacgtggggacctaagcgtgtattatggaaacgtctgtatcggataagtagcgaggagtgttcgttaaaa

SEQ ID NO: 53 - DNA, 26 bp, Artificial Sequence
  Promoter Sequence
tagagttttaaaggagtagttttaca

SEQ ID NO: 54 - DNA, 173 bp, Artificial Sequence
  Promoter Sequence
taggcatttttagtacgtgcaataaccactctggtttttccagggtggttttttgatgccctttttggagtcttcaactgcttagctttgacctgcacaaatagttgcaaattgtcccacatacacataaagtagcttgcgtatttaaaattatgaacctaaggggtttagca

SEQ ID NO: 55 - DNA, 80 bp, Artificial Sequence
  Promoter Sequence
taggcttttcgacgtctcctccggcgaaacccaaaaaaggaaccctcacagttcgtgagggttccttttactattgtcta

SEQ ID NO: 56 - DNA, 26 bp, Artificial Sequence
  Promoter Sequence
tgtaaaactactcctttaaaactcta

SEQ ID NO: 57 - DNA, 97 bp, Artificial Sequence
  Promoter Sequence
ttttaacgaacactcctcgctacttatccgatacagacgtttccataatacacgcttaggtccccacgtagtaccacacacaacgcgagaaacggca

SEQ ID NO: 58 - protein, 334 aa, Corynebacterium glutamicum
MTIRVGINGFGRIGRNFFRAILERSDDLEVVAVNDLTDNKTLSTLLKFDSIMGRLGQEVEYDDDSITVGGKRIAVYAERDPKNLDWAAHNVDIVIESTGFFTDANAAKAHIEAGAKKVIISAPASNEDATFVYGVNHESYDPENHNVISGASCTTNCLAPMAKVLNDKFGIENGLMTTVHAYTGDQRLHDAPHRDLRRARAAAVNIVPTSTGAAKAVALVLPELKGKLDGYALRVPVITGSATDLTFNTKSEVTVESINAAIKEAAVGEFGETLAYSEEPLVSTDIVHDSHGSIFDAGLTKVSGNTVKVVSWYDNEWGYTCQLLRLTELVASKL

SEQ ID NO: 59 - DNA, 97 bp, Artificial Sequence; identical to SEQ ID NO: 52
  Expression promoter P1 derived from Pcg0007_lib_39

SEQ ID NO: 60 - DNA, 97 bp, Artificial Sequence
  Expression promoter P2 derived from Pcg0007
tgccgtttctcgcgttgtgtgtggtactacgtggggacctaagcgtgtaagatggaaacgtctgtatcggataagtagcgaggagtgttcgttaaaa

SEQ ID NO: 61 - DNA, 93 bp, Artificial Sequence
  Expression promoter P3 derived from Pcg1860
cttagctttgacctgcacaaatagttgcaaattgtcccacatacacataaagtagcttgcgtatttaaaattatgaacctaaggggtttagca

SEQ ID NO: 62 - DNA, 98 bp, Artificial Sequence
  Expression promoter P4 derived from Pcg0755
aataaatttataccacacagtctattgcaatagaccaagctgttcagtagggtgcatgggagaagaatttcctaataaaaactcttaaggacctccaa

SEQ ID NO: 63 - DNA, 97 bp, Artificial Sequence
  Expression promoter P5 derived from Pcg0007_265
tgccgtttctcgcgttgtgtgtggtactacgtggggacctaagcgtgtacgctggaaacgtctgtatcggataagtagcgaggagtgttcgttaaaa

SEQ ID NO: 64 - DNA, 86 bp, Artificial Sequence
  Expression promoter P6 derived from Pcg3381
cgccggataaatgaattgattattttaggctcccagggattaagtctagggtggaatgcagaaatatttcctacggaaggtccgtt

SEQ ID NO: 65 - DNA, 97 bp, Artificial Sequence
  Expression promoter P7 derived from Pcg0007_119
tgccgtttctcgcgttgtgtgtggtactacgtggggacctaagcgtgttgcatggaaacgtctgtatcggataagtagcgaggagtgttcgttaaaa

SEQ ID NO: 66 - DNA, 87 bp, Artificial Sequence
  Expression promoter P8 derived from Pcg312
gtggctaaaacttttggaaacttaagttacctttaatcggaaacttattgaattcgggtgaggcaactgcaactctggacttaaagc

SEQ ID NO: 67 - protein, 331 aa, Escherichia coli
MTIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 68 - DNA, 996 bp, Escherichia coli
atgactatcaaagtaggtatcaacggttttggccgtatcggtcgcattgttttccgtgctgctcagaaacgttctgacatcgagatcgttgcaatcaacgacctgttagacgctgattacatggcatacatgctgaaatatgactccactcacggccgtttcgacggtaccgttgaagtgaaagacggtcatctgatcgttaacggtaaaaaaatccgtgttaccgctgaacgtgatccggctaacctgaaatgggacgaagttggtgttgacgttgtcgctgaagcaactggtctgttcctgactgacgaaactgctcgtaaacacatcaccgctggtgcgaagaaagtggttatgactggtccgtctaaagacaacactccgatgttcgttaaaggcgctaacttcgacaaatatgctggccaggacatcgtttccaacgcttcctgcaccaccaactgcctggctccgctggctaaagttatcaacgataacttcggcatcatcgaaggtctgatgaccaccgttcacgctactaccgctactcagaaaaccgttgatggcccgtctcacaaagactggcgcggcggccgcggcgcttcccagaacatcatcccgtcctctaccggtgctgctaaagctgtaggtaaagtactgccagaactgaatggcaaactgactggtatggcgttccgcgttccgaccccgaacgtatctgtagttgacctgaccgttcgtctggaaaaagctgcaacttacgagcagatcaaagctgccgttaaagctgctgctgaaggcgaaatgaaaggcgttctgggctacaccgaagatgacgtagtatctaccgatttcaacggcgaagtttgcacttccgtgttcgatgctaaagctggtatcgctctgaacgacaacttcgtgaaactggtatcctggtacgacaacgaaaccggttactccaacaaagttctggacctgatcgctcacatctccaaataa

SEQ ID NO: 69 - protein, 334 aa, Artificial Sequence
  D35G L36T mutated gapAv5 from C. glutamicum
MTIRVGINGFGRIGRNFFRAILERSDDLEVVAVNGTTDNKTLSTLLKFDSIMGRLGQEVEYDDDSITVGGKRIAVYAERDPKNLDWAAHNVDIVIESTGFFTDANAAKAHIEAGAKKVIISAPASNEDATFVYGVNHESYDPENHNVISGASCTTNCLAPMAKVLNDKFGIENGLMTTVHAYTGDQRLHDAPHRDLRRARAAAVNIVPTSTGAAKAVALVLPELKGKLDGYALRVPVITGSATDLTFNTKSEVTVESINAAIKEAAVGEFGETLAYSEEPLVSTDIVHDSHGSIFDAGLTKVSGNTVKVVSWYDNEWGYTCQLLRLTELVASKL

SEQ ID NO: 70 - DNA, 1005 bp, Artificial Sequence
  D35G L36T mutated gapAv5 from C. glutamicum
atgaccattcgtgttggtattaacggatttggccgtatcggacgtaacttcttccgcgcaattctggagcgcagcgacgatctcgaggtagttgcagtcaacggcaccaccgacaacaagaccctttccacccttctcaagttcgactccatcatgggccgccttggccaggaagttgaatacgacgatgactccatcaccgttggtggcaagcgcatcgctgtttacgcagagcgcgatccaaagaacctggactgggctgcacacaacgttgacatcgtgatcgagtccaccggcttcttcaccgatgcaaacgcggctaaggctcacatcgaagcaggtgccaagaaggtcatcatctccgcaccagcaagcaacgaagacgcaaccttcgtttacggtgtgaaccacgagtcctacgatcctgagaaccacaacgtgatctccggcgcatcttgcaccaccaactgcctcgcaccaatggcaaaggtcctgaacgacaagttcggcatcgagaacggtctcatgaccaccgttcacgcatacaccggcgaccagcgcctgcacgatgcacctcaccgcgacctgcgtcgtgcacgtgcagcagcagtcaacatcgttcctacctccaccggtgcagctaaggctgttgctctggttctcccagagctcaagggcaagcttgacggctacgcacttcgcgttccagttatcaccggttccgcaaccgacctgaccttcaacaccaagtctgaggtcaccgttgagtccatcaacgctgcaatcaaggaagctgcagtcggcgagttcggcgagaccctggcttactccgaagagccactggtttccaccgacatcgtccacgattcccacggctccatcttcgacgctggcctgaccaaggtctccggcaacaccgtcaaggttgtttcctggtacgacaacgagtggggctacacctgccagctcctgcgtctgaccgagctcgtagcttccaagctctaa

SEQ ID NO: 71 - protein, 334 aa, Artificial Sequence
  L36T T37K mutated gapAv7 from C. glutamicum
MTIRVGINGFGRIGRNFFRAILERSDDLEVVAVNDTKDNKTLSTLLKFDSIMGRLGQEVEYDDDSITVGGKRIAVYAERDPKNLDWAAHNVDIVIESTGFFTDANAAKAHIEAGAKKVIISAPASNEDATFVYGVNHESYDPENHNVISGASCTTNCLAPMAKVLNDKFGIENGLMTTVHAYTGDQRLHDAPHRDLRRARAAAVNIVPTSTGAAKAVALVLPELKGKLDGYALRVPVITGSATDLTFNTKSEVTVESINAAIKEAAVGEFGETLAYSEEPLVSTDIVHDSHGSIFDAGLTKVSGNTVKVVSWYDNEWGYTCQLLRLTELVASKL

SEQ ID NO: 72 - DNA, 1005 bp, Artificial Sequence
  L36T T37K mutated gapAv7 from C. glutamicum
atgaccattcgtgttggtattaacggatttggccgtatcggacgtaacttcttccgcgcaattctggagcgcagcgacgatctcgaggtagttgcagtcaacgacaccaaggacaacaagaccctttccacccttctcaagttcgactccatcatgggccgccttggccaggaagttgaatacgacgatgactccatcaccgttggtggcaagcgcatcgctgtttacgcagagcgcgatccaaagaacctggactgggctgcacacaacgttgacatcgtgatcgagtccaccggcttcttcaccgatgcaaacgcggctaaggctcacatcgaagcaggtgccaagaaggtcatcatctccgcaccagcaagcaacgaagacgcaaccttcgtttacggtgtgaaccacgagtcctacgatcctgagaaccacaacgtgatctccggcgcatcttgcaccaccaactgcctcgcaccaatggcaaaggtcctgaacgacaagttcggcatcgagaacggtctcatgaccaccgttcacgcatacaccggcgaccagcgcctgcacgatgcacctcaccgcgacctgcgtcgtgcacgtgcagcagcagtcaacatcgttcctacctccaccggtgcagctaaggctgttgctctggttctcccagagctcaagggcaagcttgacggctacgcacttcgcgttccagttatcaccggttccgcaaccgacctgaccttcaacaccaagtctgaggtcaccgttgagtccatcaacgctgcaatcaaggaagctgcagtcggcgagttcggcgagaccctggcttactccgaagagccactggtttccaccgacatcgtccacgattcccacggctccatcttcgacgctggcctgaccaaggtctccggcaacaccgtcaaggttgtttcctggtacgacaacgagtggggctacacctgccagctcctgcgtctgaccgagctcgtagcttccaagctctaa

SEQ ID NO: 73 - protein, 334 aa, Artificial Sequence
  D35G L36T T37K mutated gapAv8 from C. glutamicum
MTIRVGINGFGRIGRNFFRAILERSDDLEVVAVNGTKDNKTLSTLLKFDSIMGRLGQEVEYDDDSITVGGKRIAVYAERDPKNLDWAAHNVDIVIESTGFFTDANAAKAHIEAGAKKVIISAPASNEDATFVYGVNHESYDPENHNVISGASCTTNCLAPMAKVLNDKFGIENGLMTTVHAYTGDQRLHDAPHRDLRRARAAAVNIVPTSTGAAKAVALVLPELKGKLDGYALRVPVITGSATDLTFNTKSEVTVESINAAIKEAAVGEFGETLAYSEEPLVSTDIVHDSHGSIFDAGLTKVSGNTVKVVSWYDNEWGYTCQLLRLTELVASKL

SEQ ID NO: 74 - DNA, 1005 bp, Artificial Sequence
  D35G L36T T37K mutated gapAv8 from C. glutamicum
atgaccattcgtgttggtattaacggatttggccgtatcggacgtaacttcttccgcgcaattctggagcgcagcgacgatctcgaggtagttgcagtcaacggcaccaaggacaacaagaccctttccacccttctcaagttcgactccatcatgggccgccttggccaggaagttgaatacgacgatgactccatcaccgttggtggcaagcgcatcgctgtttacgcagagcgcgatccaaagaacctggactgggctgcacacaacgttgacatcgtgatcgagtccaccggcttcttcaccgatgcaaacgcggctaaggctcacatcgaagcaggtgccaagaaggtcatcatctccgcaccagcaagcaacgaagacgcaaccttcgtttacggtgtgaaccacgagtcctacgatcctgagaaccacaacgtgatctccggcgcatcttgcaccaccaactgcctcgcaccaatggcaaaggtcctgaacgacaagttcggcatcgagaacggtctcatgaccaccgttcacgcatacaccggcgaccagcgcctgcacgatgcacctcaccgcgacctgcgtcgtgcacgtgcagcagcagtcaacatcgttcctacctccaccggtgcagctaaggctgttgctctggttctcccagagctcaagggcaagcttgacggctacgcacttcgcgttccagttatcaccggttccgcaaccgacctgaccttcaacaccaagtctgaggtcaccgttgagtccatcaacgctgcaatcaaggaagctgcagtcggcgagttcggcgagaccctggcttactccgaagagccactggtttccaccgacatcgtccacgattcccacggctccatcttcgacgctggcctgaccaaggtctccggcaacaccgtcaaggttgtttcctggtacgacaacgagtggggctacacctgccagctcctgcgtctgaccgagctcgtagcttccaagctctaa

SEQ ID NO: 75 - DNA, 63 bp, Artificial Sequence
  pMB085 promoter
accgtgcgtgtttacaattttacctctggcggtgataatggttgcatgtactaaggaggttgt

SEQ ID NO: 76 - DNA, 5118 bp, Escherichia coli
ggcttttagagcaacgagacacggcaatgttgcaccgtttgctgcatgatattgaaaaaaatatcaccaaataaaaaacgccttagtaagtatttttcagcttttcattctgactgcaacgggcaatatgtctctgtgtggattaaaaaaagagtgtctgatagcagcttctgaactggttacctgccgtgagtaaattaaaattttattgacttaggtcactaaatactttaaccaatataggcatagcgcacagacagataaaaattacagagtacacaacatccatgaaacgcattagcaccaccattaccaccaccatcaccattaccacaggtaacggtgcgggctgacgcgtacaggaaacacagaaaaaagcccgcacctgacagtgcgggctttttttttcgaccaaaggtaacgaggtaacaaccatgcgagtgttgaagttcggcggtacatcagtggcaaatgcagaacgttttctgcgtgttgccgatattctggaaagcaatgccaggcaggggcaggtggccaccgtcctctctgcccccgccaaaatcaccaaccacctggtggcgatgattgaaaaaaccattagcggccaggatgctttacccaatatcagcgatgccgaacgtatttttgccgaacttttgacgggactcgccgccgcccagccggggttcccgctggcgcaattgaaaactttcgtcgatcaggaatttgcccaaataaaacatgtcctgcatggcattagtttgttggggcagtgcccggatagcatcaacgctgcgctgatttgccgtggcgagaaaatgtcgatcgccattatggccggcgtattagaagcgcgcggtcacaacgttactgttatcgatccggtcgaaaaactgctggcagtggggcattacctcgaatctaccgtcgatattgctgagtccacccgccgtattgcggcaagccgcattccggctgatcacatggtgctgatggcaggtttcaccgccggtaatgaaaaaggcgaactggtggtgcttggacgcaacggttccgactactctgctgcggtgctggctgcctgtttacgcgccgattgttgcgagatttggacggacgttgacggggtctatacctgcgacccgcgtcaggtgcccgatgcgaggttgttgaagtcgatgtcctaccaggaagcgatggagctttcctacttcggcgctaaagttcttcacccccgcaccattacccccatcgcccagttccagatcccttgcctgattaaaaataccggaaatcctcaagcaccaggtacgctcattggtgccagccgtgatgaagacgaattaccggtcaagggcatttccaatctgaataacatggcaatgttcagcgtttctggtccggggatgaaagggatggtcggcatggcggcgcgcgtctttgcagcgatgtcacgcgcccgtatttccgtggtgctgattacgcaatcatcttccgaatacagcatcagtttctgcgttccacaaagcgactgtgtgcgagctgaacgggcaatgcaggaagagttctacctggaactgaaagaaggcttactggagccgctggcagtgacggaacggctggccattatctcggtggtaggtgatggtatgcgcaccttgcgtgggatctcggcgaaattctttgccgcactggcccgcgccaatatcaacattgtcgccattgctcagggatcttctgaacgctcaatctctgtcgtggtaaataacgatgatgcgaccactggcgtgcgcgttactcatcagatgctgttcaataccgatcaggttatcgaagtgtttgtgattggcgtcggtggcgttggcggtgcgctgctggagcaactgaagcgtcagcaaagctggctgaagaataaacatatcgacttacgtgtctgcggtgttgccaactcgaaggctctgctcaccaatgtacatggccttaatctggaaaactggcaggaagaactggcgcaagccaaagagccgtttaatctcgggcgcttaattcgcctcgtgaaagaatatcatctgctgaacccggtcattgttgactgcacttccagccaggcagtggcggatcaatatgccgacttcctgcgcgaaggtttccacgttgtcacgccgaacaaaaaggccaacacctcgtcgatggattactaccatcagttgcgttatgcggcggaaaaatcgcggcgtaaattcctctatgacaccaacgttggggctggattaccggttattgagaacctgcaaaatctgctcaatgcaggtgatgaattgatgaagttctccggcattctttctggttcgctttcttatatcttcggcaagttagacgaaggcatgagtttctccgaggcgaccacgctggcgcgggaaatgggttataccgaaccggacccgcgagatgatctttctggtatggatgtggcgcgtaaactattgattctcgctcgtgaaacgggacgtgaactggagctggcggatattgaaattgaacctgtgctgcccgcagagtttaacgccgagggtgatgttgccgcttttatggcgaatctgtcacaactcgacgatctctttgccgcgcgcgtggcgaaggcccgtgatgaaggaaaagttttgcgctatgttggcaatattgatgaagatggcgtctgccgcgtgaagattgccgaagtggatggtaatgatccgctgttcaaagtgaaaaatggcgaaaacgccctggccttctatagccactattatcagccgctgccgttggtactgcgcggatatggtgcgggcaatgacgttacagctgccggtgtctttgctgatctgctacgtaccctctcatggaagttaggagtctgacatggttaaagtttatgccccggcttccagtgccaatatgagcgtcgggtttgatgtgctcggggcggcggtgacacctgttgatggtgcattgctcggagatgtagtcacggttgaggcggcagagacattcagtctcaacaacctcggacgctttgccgataagctgccgtcagaaccacgggaaaatatcgtttatcagtgctgggagcgtttttgccaggaactgggtaagcaaattccagtggcgatgaccctggaaaagaatatgccgatcggttcgggcttaggctccagtgcctgttcggtggtcgcggcgctgatggcgatgaatgaacactgcggcaagccgcttaatgacactcgtttgctggctttgatgggcgagctggaaggccgtatctccggcagcattcattacgacaacgtggcaccgtgttttctcggtggtatgcagttgatgatcgaagaaaacgacatcatcagccagcaagtgccagggtttgatgagtggctgtgggtgctggcgtatccggggattaaagtctcgacggcagaagccagggctattttaccggcgcagtatcgccgccaggattgcattgcgcacgggcgacatctggcaggcttcattcacgcctgctattcccgtcagcctgagcttgccgcgaagctgatgaaagatgttatcgctgaaccctaccgtgaacggttactgccaggcttccggcaggcgcggcaggcggtcgcggaaatcggcgcggtagcgagcggtatctccggctccggcccgaccttgttcgctctgtgtgacaagccggaaaccgcccagcgcgttgccgactggttgggtaagaactacctgcaaaatcaggaaggttttgttcatatttgccggctggatacggcgggcgcacgagtactggaaaactaaatgaaactctacaatctgaaagatcacaacgagcaggtcagctttgcgcaagccgtaacccaggggttgggcaaaaatcaggggctgttttttccgcacgacctgccggaattcagcctgactgaaattgatgagatgctgaagctggattttgtcacccgcagtgcgaagatcctctcggcgtttattggtgatgaaatcccacaggaaatcctggaagagcgcgtgcgcgcggcgtttgccttcccggctccggtcgccaatgttgaaagcgatgtcggttgtctggaattgttccacgggccaacgctggcatttaaagatttcggcggtcgctttatggcacaaatgctgacccatattgcgggtgataagccagtgaccattctgaccgcgacctccggtgataccggagcggcagtggctcatgctttctacggtttaccgaatgtgaaagtggttatcctctatccacgaggcaaaatcagtccactgcaagaaaaactgttctgtacattgggcggcaatatcgaaactgttgccatcgacggcgatttcgatgcctgtcaggcgctggtgaagcaggcgtttgatgatgaagaactgaaagtggcgctagggttaaactcggctaactcgattaacatcagccgtttgctggcgcagatttgctactactttgaagctgttgcgcagctgccgcaggagacgcgcaaccagctggttgtctcggtgccaagcggaaacttcggcgatttgacggcgggtctgctggcgaagtcactcggtctgccggtgaaacgttttattgctgcgaccaacgtgaacgataccgtgccacgtttcctgcacgacggtcagtggtcacccaaagcgactcaggcgacgttatccaacgcgatggacgtgagtcagccgaacaactggccgcgtgtggaagagttgttccgccgcaaaatctggcaactgaaagagctgggttatgcagccgtggatgatgaaaccacgcaacagacaatgcgtgagttaaaagaactgggctacacttcggagccgcacgctgccgtagcttatcgtgcgctgcgtgatcagttgaatccaggcgaatatggcttgttcctcggcaccgcgcatccggcgaaatttaaagagagcgtggaagcgattctcggtgaaacgttggatctgccaaaagagctggcagaacgtgctgatttacccttgctttcacataatctgcccgccgattttgctgcgttgcgtaaattgatgatgaatcatcagtaa

SEQ ID NO: 77 - DNA, 4684 bp, Escherichia coli
atgcgagtgttgaagttcggcggtacatcagtggcaaatgcagaacgttttctgcgtgttgccgatattctggaaagcaatgccaggcaggggcaggtggccaccgtcctctctgcccccgccaaaatcaccaaccacctggtggcgatgattgaaaaaaccattagcggccaggatgctttacccaatatcagcgatgccgaacgtatttttgccgaacttttgacgggactcgccgccgcccagccggggttcccgctggcgcaattgaaaactttcgtcgatcaggaatttgcccaaataaaacatgtcctgcatggcattagtttgttggggcagtgcccggatagcatcaacgctgcgctgatttgccgtggcgagaaaatgtcgatcgccattatggccggcgtattagaagcgcgcggtcacaacgttactgttatcgatccggtcgaaaaactgctggcagtggggcattacctcgaatctaccgtcgatattgctgagtccacccgccgtattgcggcaagccgcattccggctgatcacatggtgctgatggcaggtttcaccgccggtaatgaaaaaggcgaactggtggtgcttggacgcaacggttccgactactctgctgcggtgctggctgcctgtttacgcgccgattgttgcgagatttggacggacgttgacggggtctatacctgcgacccgcgtcaggtgcccgatgcgaggttgttgaagtcgatgtcctaccaggaagcgatggagctttcctacttcggcgctaaagttcttcacccccgcaccattacccccatcgcccagttccagatcccttgcctgattaaaaataccggaaatcctcaagcaccaggtacgctcattggtgccagccgtgatgaagacgaattaccggtcaagggcatttccaatctgaataacatggcaatgttcagcgtttctggtccggggatgaaagggatggtcggcatggcggcgcgcgtctttgcagcgatgtcacgcgcccgtatttccgtggtgctgattacgcaatcatcttccgaatacagcatcagtttctgcgttccacaaagcgactgtgtgcgagctgaacgggcaatgcaggaagagttctacctggaactgaaagaaggcttactggagccgctggcagtgacggaacggctggccattatctcggtggtaggtgatggtatgcgcaccttgcgtgggatctcggcgaaattctttgccgcactggcccgcgccaatatcaacattgtcgccattgctcagggatcttctgaacgctcaatctctgtcgtggtaaataacgatgatgcgaccactggcgtgcgcgttactcatcagatgctgttcaataccgatcaggttatcgaagtgtttgtgattggcgtcggtggcgttggcggtgcgctgctggagcaactgaagcgtcagcaaagctggctgaagaataaacatatcgacttacgtgtctgcggtgttgccaactcgaaggctctgctcaccaatgtacatggccttaatctggaaaactggcaggaagaactggcgcaagccaaagagccgtttaatctcgggcgcttaattcgcctcgtgaaagaatatcatctgctgaacccggtcattgttgactgcacttccagccaggcagtggcggatcaatatgccgacttcctgcgcgaaggtttccacgttgtcacgccgaacaaaaaggccaacacctcgtcgatggattactaccatcagttgcgttatgcggcggaaaaatcgcggcgtaaattcctctatgacaccaacgttggggctggattaccggttattgagaacctgcaaaatctgctcaatgcaggtgatgaattgatgaagttctccggcattctttctggttcgctttcttatatcttcggcaagttagacgaaggcatgagtttctccgaggcgaccacgctggcgcgggaaatgggttataccgaaccggacccgcgagatgatctttctggtatggatgtggcgcgtaaactattgattctcgctcgtgaaacgggacgtgaactggagctggcggatattgaaattgaacctgtgctgcccgcagagtttaacgccgagggtgatgttgccgcttttatggcgaatctgtcacaactcgacgatctctttgccgcgcgcgtggcgaaggcccgtgatgaaggaaaagttttgcgctatgttggcaatattgatgaagatggcgtctgccgcgtgaagattgccgaagtggatggtaatgatccgctgttcaaagtgaaaaatggcgaaaacgccctggccttctatagccactattatcagccgctgccgttggtactgcgcggatatggtgcgggcaatgacgttacagctgccggtgtctttgctgatctgctacgtaccctctcatggaagttaggagtctgacatggttaaagtttatgccccggcttccagtgccaatatgagcgtcgggtttgatgtgctcggggcggcggtgacacctgttgatggtgcattgctcggagatgtagtcacggttgaggcggcagagacattcagtctcaacaacctcggacgctttgccgataagctgccgtcagaaccacgggaaaatatcgtttatcagtgctgggagcgtttttgccaggaactgggtaagcaaattccagtggcgatgaccctggaaaagaatatgccgatcggttcgggcttaggctccagtgcctgttcggtggtcgcggcgctgatggcgatgaatgaacactgcggcaagccgcttaatgacactcgtttgctggctttgatgggcgagctggaaggccgtatctccggcagcattcattacgacaacgtggcaccgtgttttctcggtggtatgcagttgatgatcgaagaaaacgacatcatcagccagcaagtgccagggtttgatgagtggctgtgggtgctggcgtatccggggattaaagtctcgacggcagaagccagggctattttaccggcgcagtatcgccgccaggattgcattgcgcacgggcgacatctggcaggcttcattcacgcctgctattcccgtcagcctgagcttgccgcgaagctgatgaaagatgttatcgctgaaccctaccgtgaacggttactgccaggcttccggcaggcgcggcaggcggtcgcggaaatcggcgcggtagcgagcggtatctccggctccggcccgaccttgttcgctctgtgtgacaagccggaaaccgcccagcgcgttgccgactggttgggtaagaactacctgcaaaatcaggaaggttttgttcatatttgccggctggatacggcgggcgcacgagtactggaaaactaaatgaaactctacaatctgaaagatcacaacgagcaggtcagctttgcgcaagccgtaacccaggggttgggcaaaaatcaggggctgttttttccgcacgacctgccggaattcagcctgactgaaattgatgagatgctgaagctggattttgtcacccgcagtgcgaagatcctctcggcgtttattggtgatgaaatcccacaggaaatcctggaagagcgcgtgcgcgcggcgtttgccttcccggctccggtcgccaatgttgaaagcgatgtcggttgtctggaattgttccacgggccaacgctggcatttaaagatttcggcggtcgctttatggcacaaatgctgacccatattgcgggtgataagccagtgaccattctgaccgcgacctccggtgataccggagcggcagtggctcatgctttctacggtttaccgaatgtgaaagtggttatcctctatccacgaggcaaaatcagtccactgcaagaaaaactgttctgtacattgggcggcaatatcgaaactgttgccatcgacggcgatttcgatgcctgtcaggcgctggtgaagcaggcgtttgatgatgaagaactgaaagtggcgctagggttaaactcggctaactcgattaacatcagccgtttgctggcgcagatttgctactactttgaagctgttgcgcagctgccgcaggagacgcgcaaccagctggttgtctcggtgccaagcggaaacttcggcgatttgacggcgggtctgctggcgaagtcactcggtctgccggtgaaacgttttattgctgcgaccaacgtgaacgataccgtgccacgtttcctgcacgacggtcagtggtcacccaaagcgactcaggcgacgttatccaacgcgatggacgtgagtcagccgaacaactggccgcgtgtggaagagttgttccgccgcaaaatctggcaactgaaagagctgggttatgcagccgtggatgatgaaaccacgcaacagacaatgcgtgagttaaaagaactgggctacacttcggagccgcacgctgccgtagcttatcgtgcgctgcgtgatcagttgaatccaggcgaatatggcttgttcctcggcaccgcgcatccggcgaaatttaaagagagcgtggaagcgattctcggtgaaacgttggatctgccaaaagagctggcagaacgtgctgatttacccttgctttcacataatctgcccgccgattttgctgcgttgcgtaaattgatgatgaatcatcagtaa

SEQ ID NO: 78 - DNA, 2815 bp, Artificial Sequence
  pUC19 vector backbone
  misc_feature (340)..(340): n is a, c, g, or t
  misc_feature (342)..(342): n is a, c, g, or t
  misc_feature (345)..(346): n is a, c, g, or t
aatctattcattatctcaatcaggccgggtttgcttttatgcagcccggcttttttatgaagaaattatggagaaaaatgacagggaaaaaggagaaattctcaataaatgcggtaacttagagattaggattgcggagaataacaaccgccgttactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttchttsymrgnbnchnngcmssayhhtrrkbtbtgtccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacg

SEQ ID NO: 79 - DNA, 1089 bp, Lactobacillus agilis; identical to SEQ ID NO: 29

SEQ ID NO: 80 - protein, 363 aa, Lactobacillus agilis; identical to SEQ ID NO: 30

SEQ ID NO: 81 - DNA, 1104 bp, Escherichia coli
atgaaaaatgttggttttatcggctggcgcggtatggtcggctccgttctcatgcaacgcatggttgaagagcgcgacttcgacgccattcgccctgtcttcttttctacttctcagcttggccaggctgcgccgtcttttggcggaaccactggcacacttcaggatgcctttgatctggaggcgctaaaggccctcgatatcattgtgacctgtcagggcggcgattataccaacgaaatctatccaaagcttcgtgaaagcggatggcaaggttactggattgacgcagcatcgtctctgcgcatgaaagatgacgccatcatcattcttgaccccgtcaatcaggacgtcattaccgacggattaaataatggcatcaggacttttgttggcggtaactgtaccgtaagcctgatgttgatgtcgttgggtggtttattcgccaatgatcttgttgattgggtgtccgttgcaacctaccaggccgcttccggcggtggtgcgcgacatatgcgtgagttattaacccagatgggccatctgtatggccatgtggcagatgaactcgcgaccccgtcctctgctattctcgatatcgaacgcaaagtcacaaccttaacccgtagcggtgagctgccggtggataactttggcgtgccgctggcgggtagcctgattccgtggatcgacaaacagctcgataacggtcagagccgcgaagagtggaaagggcaggcggaaaccaacaagatcctcaacacatcttccgtaattccggtagatggtttatgtgtgcgtgtcggggcattgcgctgccacagccaggcattcactattaaattgaaaaaagatgtgtctattccgaccgtggaagaactgctggctgcgcacaatccgtgggcgaaagtcgttccgaacgatcgggaaatcactatgcgtgagctaaccccagctgccgttaccggcacgctgaccacgccggtaggccgcctgcgtaagctgaatatgggaccagagttcctgtcagcctttaccgtgggcgaccagctgctgtggggggccgcggagccgctgcgtcggatgcttcgtcaactggcgtaa

SEQ ID NO: 82 - protein, 367 aa, Escherichia coli
MKNVGFIGWRGMVGSVLMQRMVEERDFDAIRPVFFSTSQLGQAAPSFGGTTGTLQDAFDLEALKALDIIVTCQGGDYTNEIYPKLRESGWQGYWIDAASSLRMKDDAIIILDPVNQDVITDGLNNGIRTFVGGNCTVSLMLMSLGGLFANDLVDWVSVATYQAASGGGARHMRELLTQMGHLYGHVADELATPSSAILDIERKVTTLTRSGELPVDNFGVPLAGSLIPWIDKQLDNGQSREEWKGQAETNKILNTSSVIPVDGLCVRVGALRCHSQAFTIKLKKDVSIPTVEELLAAHNPWAKVVPNDREITMRELTPAAVTGTLTTPVGRLRKLNMGPEFLSAFTVGDQLLWGAAEPLRRMLRQLA

SEQ ID NO: 83 - DNA, 1059 bp, Unknown
  Gene ID asd_1 sequence from unknown bacterial species from environmental sample
atgaaaccgatcgaggtgggcctgctcggcgcgacagggatggtcggacagcagttcgtgcgccagctgcgcgcgcacccctggttccggctcacgtggctcggagcgagcgatcgttccgccggccggcggtacggcgatctctcgtggcggctttccgatccgatgcccgacgccgtacgggatctcaccgtcgagtcgtgtcggcccggaagcgcgccgcgggtgctgttctcggcgctggatgccgcggccgccgacgagatcgaagcggtcttcgcccaggccggccacgtcgtcgtcagcaacgcccgatcccaccgcatgcgccccgacgtcccgctgctcgtgccggaaatcaacccggatcatctgggtcttctcgccgtgcagcggcggaaggcgggcctctcgggcacgccaagcagcggcgcaatcgtcacgaacccgaactgctcaaccgtgtttctcgctatggcgctcggcgcgctgcgtccgcttcgcccggcgcgtgcgatcgtgaccacactgcaggccgcctccggcgcgggctatccgggcgtgccctctctcgatctgctcggcaatgtcatccctttcatttctggggaggaggaaaagatcgagaccgagacgcgcaagatcctcggccagctccgcggcgatgccatcaccccgcacccgattgcgcttagcgcgcaggtgaaccgcgtaccggtcgtgaacggccacaccgaggcggtctcggtggcgttcgacgaggctccgccgcgggatgcggtcctggaagcgctcacgcgattcaccgggctcccgcagcagcaacagttgcccagcgctcccgcgaatcctttgatctatatgtccgagacggatcgtccgcagcctcgtctcgacgtggagcgcgatggcggcatgacggtgtgtgtggggcgcctccgcgcctgtccagtgctgcactggaagttcgtcctgctgggccacaacacgattagaggcgccgcgggtgcggccgttctgaacgccgagctgatggtagccggcggatggctggattga

SEQ ID NO: 84 - protein, 352 aa, Unknown
  Gene ID asd_1 sequence from unknown bacterial species from environmental sample
MKPIEVGLLGATGMVGQQFVRQLRAHPWFRLTWLGASDRSAGRRYGDLSWRLSDPMPDAVRDLTVESCRPGSAPRVLFSALDAAAADEIEAVFAQAGHVVVSNARSHRMRPDVPLLVPEINPDHLGLLAVQRRKAGLSGTPSSGAIVTNPNCSTVFLAMALGALRPLRPARAIVTTLQAASGAGYPGVPSLDLLGNVIPFISGEEEKIETETRKILGQLRGDAITPHPIALSAQVNRVPVVNGHTEAVSVAFDEAPPRDAVLEALTRFTGLPQQQQLPSAPANPLIYMSETDRPQPRLDVERDGGMTVCVGRLRACPVLHWKFVLLGHNTIRGAAGAAVLNAELMVAGGWLD

SEQ ID NO: 85 - DNA, 1179 bp, Unknown
  Gene ID asd_2 sequence from unknown bacterial species from environmental sample
atggctcagatagcggagttgacgcgagacgcggagggcgcggccgccgtcgcggggggcaagttgcgggtggcattgctgggcgcgaccgggatggtcggccagcagttcatacgcgtgctcagaaatcatccctggttcgagatcgccgtcctcgcggcgtccgagtcctcggcgggcaagacgtaccgcgaggcgttgcgcggccgctgggcgatggagttcgccgtgccggaagagttggccggggtcaaagtcctggacgtgcaatcggtggacgagatcgccgcgcaggcggacgtggccttctgcgcgctcaacctcgaaaaggaggccgtccgcgcgctcgaagacgcctacgcgcgcaggggcgtgtgggtgacctcgaacaactccgccttccggcaagaccccctcgtgccgatggtcatcccggcggccaacgcgcaccacctcggcgtcgtcccgcaccagcgccgcgcgcgcggctacgacacgggcgcgatcatcgtcaagagcaactgctcgatccagagttacgtcatcgcgctcgaaccgctcagggatttcggcgttacgcgaatcaacgtcttcagcgcgcaggccatctcgggcgcgggcaagactttcaagacctggcccgagatgcgcgacaacctcatcccacacatcggcggcgaggaggagaagtccgagaccgagcccctgaagatttggggcgaggcgacgagcgacggcatcgtgccggcgaacggcccgaagattcgcgcgcgttgcgtgcgcgtcggagtcgccgacggccacaccgcccaggtcaccgtcgctttcaaggccgtccccacggccgcgcagattctggagcgctgggagcggcacaggggccgcgccgccgacctgccctcggccccgcgccgcctcatacactaccgcccggagaaggatcgcccacagcccgcgctcgacgtgatgaccgagaacggcatggccgtcaccgtcggccacctacgggtcgagccggatgaagccacggcctccttcaccgccctcgcacacaacgccatcctcggcgcggcgggcggcgcggtctgggcgaccgaggcggccctggcccgcgggctcctctaccgccgcatcgccccgcaacgaaagaccaggccccagacggcgaaggcgctctga

SEQ ID NO: 86 - protein, 392 aa, Unknown
  Gene ID asd_2 sequence from unknown bacterial species from environmental sample
MAQIAELTRDAEGAAAVAGGKLRVALLGATGMVGQQFIRVLRNHPWFEIAVLAASESSAGKTYREALRGRWAMEFAVPEELAGVKVLDVQSVDEIAAQADVAFCALNLEKEAVRALEDAYARRGVWVTSNNSAFRQDPLVPMVIPAANAHHLGVVPHQRRARGYDTGAIIVKSNCSIQSYVIALEPLRDFGVTRINVFSAQAISGAGKTFKTWPEMRDNLIPHIGGEEEKSETEPLKIWGEATSDGIVPANGPKIRARCVRVGVADGHTAQVTVAFKAVPTAAQILERWERHRGRAADLPSAPRRLIHYRPEKDRPQPALDVMTENGMAVTVGHLRVEPDEATASFTALAHNAILGAAGGAVWATEAALARGLLYRRIAPQRKTRPQTAKAL

SEQ ID NO: 87 - DNA, 1245 bp, Unknown
  Gene ID asd_3 sequence from unknown bacterial species from environmental sample
atgtattatggatttgaagtaatcatcccgctccggctaaaactggcgggtaacatcaacaaaggcggaaacaacgaggtagtaatggctcatatagaagaaatcgctcgtcttgaggccgggagcgcccgactctcaggcggaaagttgaaggtcgctgtgctgggcgcaaccgggatggtgggccaacagttaataagacttctatcggatcatccctggtttgaagttgttgtggttgccgcctcaactaattctgaaggtagctcttattcggaagctgtccggggtcgttggacaatggcagctcgcatcccggatgaaattgccgcaatgaacgtttgggacgttcagtcggtggacgagatagcggctcaagttgatatcgcgttctgcgcaatcaaccttgataaggaaggtgtgttgaagttggaacacgcatacgcagctgcgggagtatgggttacttccaacaattcggcgtaccggccggacccgttcgtgcctatggtgattcccgccgtcaatccgcatcacctggacttgatcccccaccagcgccaaacaaagggctatcgaaccggcgcgcttatagtaaagagcaattgctctattcagagttatgtaatcgcactggacccgctccgggaattcggcatcgaaaacgtaagtatccacagcgaacaggcgatctccggcgcgggtaagacgtttgagacttttccggatattgagcgcaacctgattccactaattaacggcgaagaaaagaagtcagaggtcgagccgctgaagatctggggccagctcgaggctggaggaattgtgccagcaacaggaccacgcattagggcgaagtgcgttagagtaggtgtcctccatggacatacagcttatgcgacagtgagattccgagacactccaactgtggcccagatcctggaacgatgggagaactacaaatcaccgaaccaacttccatcgtcgcctcggaaattgattcactacttgccagaacccgaccggccccagccacgtctggatgtgatgacggagaacggcatggcagtaagtatcggacaattgaagattgacagcgataagtctgtttcctttaccggcctttctcataatctgatcctgggagctgctggtggtgccgtacttgccaccgaagcagccgttgccagggaacttgtctatcgcagaatcttatctcgccaggagataccgcagccggcatag

SEQ ID NO: 88 - protein, 414 aa, Unknown
  Gene ID asd_3 sequence from unknown bacterial species from environmental sample
MYYGFEVIIPLRLKLAGNINKGGNNEVVMAHIEEIARLEAGSARLSGGKLKVAVLGATGMVGQQLIRLLSDHPWFEVVVVAASTNSEGSSYSEAVRGRWTMAARIPDEIAAMNVWDVQSVDEIAAQVDIAFCAINLDKEGVLKLEHAYAAAGVWVTSNNSAYRPDPFVPMVIPAVNPHHLDLIPHQRQTKGYRTGALIVKSNCSIQSYVIALDPLREFGIENVSIHSEQAISGAGKTFETFPDIERNLIPLINGEEKKSEVEPLKIWGQLEAGGIVPATGPRIRAKCVRVGVLHGHTAYATVRFRDTPTVAQILERWENYKSPNQLPSSPRKLIHYLPEPDRPQPRLDVMTENGMAVSIGQLKIDSDKSVSFTGLSHNLILGAAGGAVLATEAAVARELVYRRILSRQEIPQPA

SEQ ID NO: 89 - DNA, 1089 bp, Unknown
  Gene ID asd_4 sequence from unknown bacterial species from environmental sample
atgagctcctctcgcatcccggtccttatactcggtgcgaccggcatggtcggacagagattcgtctccctcttgagcgatcatccctggtttcaaatagctggtgttgcggcgtccccgaattcggcaggggttccttaccgcgaagccgttcgtggcagatggctccttgagtctgacattccagatagtgtgggtggtctcacggtgtaccgtgtagaggaagatgccgaattcctttcgaagttgggccaggtggctttttgtgcgctcgatctaccgaaggaacgggtccaggctatcgagtgtgattatgcgcgtcggggcgtggctgttatatcgaacaattctgcacaccgtcttacgagtgacgtgccggtcttaatgccagagataaatcctgatcacagtgagattataactcagcaaagaaaaaaccgagggtggtcatgcgggcttatcgcggtgaagccaaactgctcaatccagtcttatgtcccagtccttgccgccctttctgagctcaaggtcgagcgagtatcagtcacgacgctgcaagcagtctccggcgccggaaagaccctaaacagctggccagagatggtcgacaatgtgattcctttcattcgtggcgaagaagaaaagagcgagattgaacctctcaaagttctcggtaccgtaaccgaggctggaatcgcaccgagacgggacctcaagatctctgcaacttgtattcgagtcccggtctctgacgggcatatggccagtctcaccttttcgctcggcgtatcggcctcagcgggggagattgttgagcgattaaaggctttcaaaccaagatctaaaggcttagaactcccctcgtcgccggaactgtttcttgcatattcgtccgatgacgaccggccgcagactcgtcttgatcgggacactgaaagaggaatgggagtttcagttggacgtctccgagaagattctgttctggggtggaagtgtgttgcactttcgcacaatacggttcgcggggctgccggcggtgccgtactgatggcagagcttcttcataagcagggctatatcaaaggctaa

SEQ ID NO: 90 - protein, 362 aa, Unknown
  Gene ID asd_4 sequence from unknown bacterial species from environmental sample
MSSSRIPVLILGATGMVGQRFVSLLSDHPWFQIAGVAASPNSAGVPYREAVRGRWLLESDIPDSVGGLTVYRVEEDAEFLSKLGQVAFCALDLPKERVQAIECDYARRGVAVISNNSAHRLTSDVPVLMPEINPDHSEIITQQRKNRGWSCGLIAVKPNCSIQSYVPVLAALSELKVERVSVTTLQAVSGAGKTLNSWPEMVDNVIPFIRGEEEKSEIEPLKVLGTVTEAGIAPRRDLKISATCIRVPVSDGHMASLTFSLGVSASAGEIVERLKAFKPRSKGLELPSSPELFLAYSSDDDRPQTRLDRDTERGMGVSVGRLREDSVLGWKCVALSHNTVRGAAGGAVLMAELLHKQGYIKG

SEQ ID NO: 91 - DNA, 1086 bp, Unknown
  Gene ID asd_5 sequence from unknown bacterial species from environmental sample
atggcaaacaagctcaaggtaggcgtcctcggcgcgaccggcatggtcggccagaggttcgtatcgctgctcgcggaccatccgtggttcgaggtctctgcggtcgctgcaagcgcatcgagcgcaggcaaatcgtacgcagacgcagtctcggggcgctggacgctcgagacgcccgtcccgacagccgttgcaaaacagacggtcagcgacgcgtcgcagattcaaaagatcgcggacgcctgcgacttcgtcgtgtgcgcggtcgatatggacaaagcggcgaccgcgaagctcgaagaagactacgcgcgtgcggagacgccggtcgtttcgaacaactcggcgcatcgttggacgccagacgtcccgatgatgatccccgagatcaactcgcaccacaccgacgtgatcgaagcgcaacgcaagcgcctcggcacgaagcgcggcttcatcgcggtgaaaccgaactgttcgatccaatcgtacgtccctgcgatccatccgctcgcggcattcaagcccacgaagatcgcggtctgcacgtatcaagcgatcagcggtgcgggcaaaacgttccagtcatggcccgacatgatcgacaacgtcatccccttcatcaaaggtgaagaggaaaagagcgagaaggaaccgctcaaggtgtggggcacggtgaagggcggagaaattgtcgccgctccatcgccgacgatcacggcgcaatgcattcgcgtgcccgtcagtgacggtcacatggccgcggtgttcgtcgcgttcgagcgcaagccaacgcgcgagcaaatcctctctgcgtggaaagagttcacgggtaagccgcagcaagcgaagctgccgagcgcgccaacgccgttcctcaattacttcgaggacgacacgcgcccgcagaccaaactcgatcgcgacaacggtgacggccaagccatctcgatcggtcgtctgcgcgaagacgcgatgttcgattggaagttcgtcgcgctttcacacaacaccgtccgcggtgccgcaggtggcgctgtactcactgccgagttcctcaaacatgaaggtttcctggcagcgaagtag

SEQ ID NO: 92 - protein, 361 aa, Unknown
  Gene ID asd_5 sequence from unknown bacterial species from environmental sample
MANKLKVGVLGATGMVGQRFVSLLADHPWFEVSAVAASASSAGKSYADAVSGRWTLETPVPTAVAKQTVSDASQIQKIADACDFVVCAVDMDKAATAKLEEDYARAETPVVSNNSAHRWTPDVPMMIPEINSHHTDVIEAQRKRLGTKRGFIAVKPNCSIQSYVPAIHPLAAFKPTKIAVCTYQAISGAGKTFQSWPDMIDNVIPFIKGEEEKSEKEPLKVWGTVKGGEIVAAPSPTITAQCIRVPVSDGHMAAVFVAFERKPTREQILSAWKEFTGKPQQAKLPSAPTPFLNYFEDDTRPQTKLDRDNGDGQAISIGRLREDAMFDWKFVALSHNTVRGAAGGAVLTAEFLKHEGFLAAK

SEQ ID NO: 93 - DNA, 1089 bp, Unknown
  Gene ID asd_6 sequence from unknown bacterial species from environmental sample
atgacagctcacgatctcaaggttgccgtgctcggcgcgaccggcatggtcggacagcggttcgtctctctcctcgacggccatccctggttccaggtgacggtcgtggccgcgagcgcccgatcggccgggcggccctacggcgatgcggtcgccggccgctggtcgctctcgaaaccggtcccggcccggatcgcggaacgggtcgtgcgggacgcctcgaacatcgccgccatcgcggacgaggtggacctcgtcttctgcgcggtcgatctatcgaaggaggagacgcgcgccctcgaggacgggtatgcccggcgcgagacgccggtcatctcgaacaactccgcgcaccgcggcaccccggacgtcccgatgatgatcccggaggtcaacccggagcacgccgagatcatcgcggcgcagcggcggcgtctcggcacccgacgcggcttcgtggcggtgaagccgaactgctcgctccagtcttacctgcccgcgctccatccgctccgcgatctcggcctcgagaaggtcatggtggcgacctaccaggccatctcgggggccggcaagaccttcgcgtcctggccggagatgaccgacaacgtcatccccttcatcaagggcgaggaggagaagagcgagcaggagccgctcaagatctggggtcgcgtggacggcgaccggatcgctccggcccgcgagccgatcatctccgcgcaatgcatccgcgtcccggtgaccgatggacacctggcggcggtctctctgtcgctggctcgcaagcagacgcccgaggcgatcatccggcgctggcgcgaatacgagggcaagccgcagcgcctcggattgccgagcgccccgcgtccgttcctggtctatcacgacgacgactcgagaccgcagacccggctcgaccgcgacgccggcaatggaatggcgatcagcatgggccggctccgccccgatccgctgttcgactatcgcttcgtcgcgctgtcgcacaacacggtgcgcggcgccgccggcggcggggtactcacggccgagctgctcgtcgcggacggctacatcgagcgcaagtag

SEQ ID NO: 94 - protein, 362 aa, Unknown
  Gene ID asd_6 sequence from unknown bacterial species from environmental sample
MTAHDLKVAVLGATGMVGQRFVSLLDGHPWFQVTVVAASARSAGRPYGDAVAGRWSLSKPVPARIAERVVRDASNIAAIADEVDLVFCAVDLSKEETRALEDGYARRETPVISNNSAHRGTPDVPMMIPEVNPEHAEIIAAQRRRLGTRRGFVAVKPNCSLQSYLPALHPLRDLGLEKVMVATYQAISGAGKTFASWPEMTDNVIPFIKGEEEKSEQEPLKIWGRVDGDRIAPAREPIISAQCIRVPVTDGHLAAVSLSLARKQTPEAIIRRWREYEGKPQRLGLPSAPRPFLVYHDDDSRPQTRLDRDAGNGMAISMGRLRPDPLFDYRFVALSHNTVRGAAGGGVLTAELLVADGYIERK

SEQ ID NO: 95 - DNA, 1059 bp, Unknown
  Gene ID asd_7 sequence from unknown bacterial species from environmental sample
gtgaagcaacgcgtcgggatcctcggagcgacggggctcgtcgggcagcggctcgtccgcatgctcgagggccatccgctcttcgaagtgagcgcactggctgcctccgaccgctccgagggacggccttacgcggacgcgtgcccgtggcggctcgccgaccccatgcccgaatcggtcgcgggcttgcggctggccccctgctcgccgccgctcgactgcgacttcgtcatcgcgagcctgccgtccgaggtcgccctcgaggccgagacggccttcgccgcggccggctacccggtcgtcagcaactcctcggccctccgcatggccgaggacgtaccgctcgtcgtccccgaggtcaaccccgaccacacggccctgctggccgagcagcgacgccggcgcggctgggatcgtggcttcgtcctcgcgaacccgaactgctcgacgatcgcgctcgcgctcgcgctcgccccgctcgaacgccgcttcggcctcgaggccgtcgtcgtgacgacgatgcaggcgatctcgggcgccggatacccgggcgtctcggccgtcgacatcgccgacaacgtcctgccccacatcgcgggcgaggaggagaagctcgagaccgagccgctcaagatcttcgggcgcttcaccggcgccgggatcgagccggcgagctttgccgtcagcggccaatgccaccgcgtcgccgtccaggacggccacctcgaagcggtccgcgtcaagctcgcgcggcgcgcctcggtcgcggaggtcgtcgaggccctcgaaaccttccggggcctgccgcaggagctgcgcctgccgacggcgcccgagcgccccgtcgtcgtccggcgtgaaacggaccggcctcagccccgcctcgaccgcgacgccgagggcggcatggccacggtcgtcggccggatcgccgccgaccgcgtcctcgacttcaagctcacgctcctcggccacaacacgatccggggcgccgcgggcggggcgctcctcaacgccgaactgctcgacgcccagggcctgctcgggccccgcgcgtga

SEQ ID NO: 96 - protein, 352 aa, Unknown
  Gene ID asd_7 sequence from unknown bacterial species from environmental sample
VKQRVGILGATGLVGQRLVRMLEGHPLFEVSALAASDRSEGRPYADACPWRLADPMPESVAGLRLAPCSPPLDCDFVIASLPSEVALEAETAFAAAGYPVVSNSSALRMAEDVPLVVPEVNPDHTALLAEQRRRRGWDRGFVLANPNCSTIALALALAPLERRFGLEAVVVTTMQAISGAGYPGVSAVDIADNVLPHIAGEEEKLETEPLKIFGRFTGAGIEPASFAVSGQCHRVAVQDGHLEAVRVKLARRASVAEVVEALETFRGLPQELRLPTAPERPVVVRRETDRPQPRLDRDAEGGMATVVGRIAADRVLDFKLTLLGHNTIRGAAGGALLNAELLDAQGLLGPRA

SEQ ID NO: 97 - DNA, 1146 bp, Unknown
  Gene ID asd_8 sequence from unknown bacterial species from environmental sample
atgaacaagaaattccgagtcggcattctcggggcaaccggcatggtcggtcagcgattcgtccaactgctggagaatcatccgctttttgaaatcacggcgctggcggcgtctggtcgttcgcaaggaaagacttacgccgaagcctgcacctggcgtttgcccggcgaattgccggatggcgtgaaacagatcgtcgtgcagccgcccgcgccgccactcgactgcgatttcgttttctccagtttgccgggcgaggtcgcggctgatgccgagcttaagttcgcacgaatggattttccagtgatcagtaattcttcatcgcatcgcatggcgccggatgttccgttgctgattccggaagtcaatcctgaacacgtcgaactgatcgacgcgcagcgcattaaccgcgaatacaatcgcgggttcatcgtcacaaatcccaactgctcagcgatcgcggttgtgttggcactggcgccgttgcatgcaaagtttggcgtgagcgagtgcgtcgtgaccacgatgcaagccctctcgggcgccggttatccaggtgttgcttctctcgacgccattgacaacgtaattccattcatcggcggcgaggacgagaaggtcgagatcgaaaccaaaaagctcctcggcgtcgtgagccagggcacaatcgcggacgctaacctgaaagtcagcgcgcaatgtaaccgcgtgaatgtgaccgacggtcacatggcttcgattcgggtgaaactggcgcagccggcatccaccagcgaagttatcgacgtgctcgcatcgttcaccgccgagccccaaaagctgaaacttcactcagcgccggcgaaaccactcatcgtccgcgacgaaattgatcggccacagcctcgacttgatcgtgatgcgggaaatggaatgagcgttaccgtggggcgactcgcgaaagataacgttttggattatcgcttcgtggcgctgggtcataacacgattcgcggcgccgcgggggcggcgattctgaatgcagagttgctggtggcgaaaggatactcgcgtgactacgcgccgccaagatggcggcgaaccgcaggcagggatgcctgcgctcccatccattccgtaatcactcgtttcaactcgtccaactga

SEQ ID NO: 98 - protein, 381 aa, Unknown
  Gene ID asd_8 sequence from unknown bacterial species from environmental sample
MNKKFRVGILGATGMVGQRFVQLLENHPLFEITALAASGRSQGKTYAEACTWRLPGELPDGVKQIVVQPPAPPLDCDFVFSSLPGEVAADAELKFARMDFPVISNSSSHRMAPDVPLLIPEVNPEHVELIDAQRINREYNRGFIVTNPNCSAIAVVLALAPLHAKFGVSECVVTTMQALSGAGYPGVASLDAIDNVIPFIGGEDEKVEIETKKLLGVVSQGTIADANLKVSAQCNRVNVTDGHMASIRVKLAQPASTSEVIDVLASFTAEPQKLKLHSAPAKPLIVRDEIDRPQPRLDRDAGNGMSVTVGRLAKDNVLDYRFVALGHNTIRGAAGAAILNAELLVAKGYSRDYAPPRWRRTAGRDACAPIHSVITRFNSSN

SEQ ID NO: 99 - DNA, 1128 bp, Unknown
  Gene ID asd_9 sequence from unknown bacterial species from environmental sample
atgctcgcagttgaaaccgaaactactgaaggtcccagcttacaaggtcggaagaatcgcgtcggaattttaggcgcgacgggaacggttggtcagcgcttcattcaacttctggagcaccatccgcaattcgaggtgacggcgctggccgcctcggatcgctcgcagggacggcgatacgcggatgcctgcacctggcgtctgccgggcgcgatgccggaatcggtacgcgcgctgatggtggaagccccggcgccgccgcttgactgcgatttggttttctcaagcctgccgtcccagattgcccgcgatgctgaggttgccttcgcgagagccggctatcccgtcatcagcaactcgtccgcctgccgcatggatgacgacgtgccgcttttgatcccggaggtaaatgccgagcatctcgggattctcgatcaccaacggaagctgcgccgttttccggggaacggtttcattgttaccaatccaaattgtgcggcaattgtattggcgccggtgctggccgcgctacatgaacgtttccaagtcgtttcggtcattgccactaccatgcaggcgatctccggcgctggttatcccggcgtggcctcccttgatattgtcgataatctgattccttttatcgacggcgaagaggacaagattgaagcggagactctgaagattctcggccgactagatacggaaagaattgagcccgcaagaatccttattagtgcgcagtgccatcgtgtcaatgtcattgatggccacacggtagcggcgcggctgaagctggcgcgccaaccacagcttgatgaagtgcgcgatgtcctgcggtcattcagatcgttgccgcaagaactgcgccttcactcagctccggaaaaaccaattgtggtgcatgacgaggttgaccggccgcagccgcggctcgatcgcgatgcgggcaacggcatgagtattactgtcggtcgcctggcgggcgatcgcgtcttggactttcgcttggtggcgctcggtcataacacgattcgcggagccgcgggcgcggccatcttgaatgctgaattgttattggcgaaaggacatttttccaagacttcggatagggcgatggccgcttag

SEQ ID NO: 100 - protein, 375 aa, Unknown
  Gene ID asd_9 sequence from unknown bacterial species from environmental sample
MLAVETETTEGPSLQGRKNRVGILGATGTVGQRFIQLLEHHPQFEVTALAASDRSQGRRYADACTWRLPGAMPESVRALMVEAPAPPLDCDLVFSSLPSQIARDAEVAFARAGYPVISNSSACRMDDDVPLLIPEVNAEHLGILDHQRKLRRFPGNGFIVTNPNCAAIVLAPVLAALHERFQVVSVIATTMQAISGAGYPGVASLDIVDNLIPFIDGEEDKIEAETLKILGRLDTERIEPARILISAQCHRVNVIDGHTVAARLKLARQPQLDEVRDVLRSFRSLPQELRLHSAPEKPIVVHDEVDRPQPRLDRDAGNGMSITVGRLAGDRVLDFRLVALGHNTIRGAAGAAILNAELLLAKGHFSKTSDRAMAA

SEQ ID NO: 101 - DNA, 1065 bp, Unknown
  Gene ID asd_10 sequence from unknown bacterial species from environmental sample
atgaaaaagaaataccgtgtcggaatcttaggcgcgacggggacggtcgggcagcggttcattcaactgctcgaaggccacccgcagttcgaggtgacggcgctcgcggcctcggaccgctcgcaggggcggccttacgccgaggcgtgcgcgtggcgtctgccgggcgagatgccggaggccgtgcgctcaatcgaggtccgaacgcccgcgccgccgctcgactgcgaccttgtcttttcgagcctccccggcgagatggcgcgcgaggcggaagaatctttcgcgggcgccggctacgccgtcgtcagcaactcttcggcgctcaggatggacgaggacgtgccgctactgataccggaggtcaaccacgagcacctcgcgctgctcgacgcgcaacgcgagcggcgcggctacgaaagaggcttcgtcgtcaccaacccgaactgctcgaccgtcgtcgtcgcgctcgcgctcgcgccgctgcacgcgaggttcggcgtcgaggcggtcgcggccgtcaccatgcaggccatttccggcgcgggctaccccggcgtcgcctcgctcgacatcgccgacaacgtcctgccccacatctccggcgaggaggaaaaaatagagagcgagaccggcaagatactcggccgcctagcgggcgggggcgcgtcggcgcgcgtcgagcgcgcgcagttccccgtcagcgcgcagtgccaccgcgtcggcgtaacggacggacacacggcggccgtccgcatcaaactctcacgccccgccgaacccggtgagctgcgcgaggccttcgccgcctacacttcgctgccgcaggagttgaaactccacaacgcgcccgaacgccccgtcgtcttccgcgacgaagacgaccgcccgcagcccaaactcgaccgcgacgccggaggcgggatgagcgtcaccgtcggccgcctccggcgcgaccgcgtgatggactaccgcttcgtcgccctcggccacaacaccgtccgcggcgcggccggcgcggccatcctcaacgccgaactgctcgccgccaccggacgactgtaa

SEQ ID NO: 102 - protein, 354 aa, Unknown
  Gene ID asd_10 sequence from unknown bacterial species from environmental sample
MKKKYRVGILGATGTVGQRFIQLLEGHPQFEVTALAASDRSQGRPYAEACAWRLPGEMPEAVRSIEVRTPAPPLDCDLVFSSLPGEMAREAEESFAGAGYAVVSNSSALRMDEDVPLLIPEVNHEHLALLDAQRERRGYERGFVVTNPNCSTVVVALALAPLHARFGVEAVAAVTMQAISGAGYPGVASLDIADNVLPHISGEEEKIESETGKILGRLAGGGASARVERAQFPVSAQCHRVGVTDGHTAAVRIKLSRPAEPGELREAFAAYTSLPQELKLHNAPERPVVFRDEDDRPQPKLDRDAGGGMSVTVGRLRRDRVMDYRFVALGHNTVRGAAGAAILNAELLAATGRL

SEQ ID NO: 103 - DNA, 1071 bp, Unknown
  Gene ID asd_11 sequence from unknown bacterial species from environmental sample
atgactaaaaagtttcgtgtcggcattcttggagcgacgggcgtcgttggccagcgctttattcaattgctcgaaggccatccgcaatttgagatcgcggctctcgcagcatctgatcgatcgcaggacaaaactttcgccgaggcgtgcaagtggcgactgccgggcgacatgcctgagcacgtgagagagattgtcgttcagccgccggcccccccgcttgattgcgactttgttttttccagtttgcctaccgacatcgcgactgacgccgaaacacaattcgcgctcgcgggctatccggtgatcagcaattcatcttcgcatcgcatgggcgctgacattcctttgttgattccggaagtgaattcggatcacattgcgcttatcgacgtgcagcgaaagaaccgtggctacgagcgcggctttatcgtcactaatccaaactgttccgcgattgccattgtgatggcgctcgcaccgcttcatgaaaaattcggaatcacgtcgtgcgtcgcgaccactatgcaggcgctttccggcgccggctatccgggcgtagcgtcgctcgacgcgacggacaatgtgatcccgtttattggcggtgaagaagagaagatcgaagccgagactttaaagttgctcggggaagtgggcgacggcgtcatcgacgatgccaaaatgtccgtgagtgcccagtgtaaccgcgtgaatgttaccgacggacatctcgcgtcgattcgcgtgaagctttcgcaatcagcatcactagaccaaataaaagaaacactgtcttcatttagggccgtaccgcaggagttgaaactgcattcggcgccggtccggccggtcatcgttcgcgacgaagttgatcgcccccagccgcgtttggatcgggacgcggaaaatgggatgagcgtcactgtgggccgaattatgccggacaacgtgctcgacttccggtttgtggcgctcggccacaatacgatccgtggcgcggccggcgcggcgattttgaatgctgagttgctggtggcccgaggatatttgagtcagaaccacctgcgatag

SEQ ID NO: 104 - protein, 356 aa, Unknown
  Gene ID asd_11 sequence from unknown bacterial species from environmental sample
MTKKFRVGILGATGVVGQRFIQLLEGHPQFEIAALAASDRSQDKTFAEACKWRLPGDMPEHVREIVVQPPAPPLDCDFVFSSLPTDIATDAETQFALAGYPVISNSSSHRMGADIPLLIPEVNSDHIALIDVQRKNRGYERGFIVTNPNCSAIAIVMALAPLHEKFGITSCVATTMQALSGAGYPGVASLDATDNVIPFIGGEEEKIEAETLKLLGEVGDGVIDDAKMSVSAQCNRVNVTDGHLASIRVKLSQSASLDQIKETLSSFRAVPQELKLHSAPVRPVIVRDEVDRPQPRLDRDAENGMSVTVGRIMPDNVLDFRFVALGHNTIRGAAGAAILNAELLVARGYLSQNHLR

SEQ ID NO: 105 - DNA, 1053 bp, Unknown
  Gene ID asd_12 sequence from unknown bacterial species from environmental sample
atgtccaaaaaattccgagtgggtatcctgggagcaaccggcgttgtcggtcagcgttttattcaattactcgaaaaccatccgcaatttgaagtcgcggcgcttgcggcatctgatcgttcgcagggaaaaagttatgtcaacgcctgcacctggcgtttacccggcgagatgccggaagcggtaaagaacattattgtccaacctccttcaccgcccctcaattgcgatttcgtcttttccagtttgcccggggagattgccaggacggccgaagaggattttgcccgggccggttacccggtgatcagcaattcgtcatcgcaccgcatgggattagacattcctttgctgatcccagaagtgaatcctgaccacctcgaattgatcgatgctcagcgcacaaatcacgaatacaatcgtggcttcattgtaacgaatcccaattgttccgcgatcgccatcgtaatcgcgctggctccgctgcatgagaagtttggggtcagctcctgcgtcgtgacgacaatgcaggccctctccggcgccggctatcccggtgtaccgtctctcgacgcaaccgacaacgtgattccttttatcggcggcgaagatgagaaggtcgagtgcgaaacgcggaagattctcggcgtggtgacgcaaggcgcagtcgttgatgccgacatgacgataagtgcgcagtgcaatcgcgtgaacgttacggatggacatatggcgtcgattcgcgtgaagctggcccgttccgccacgctggaagagattcgcgaagcgttggtttcctttaccgctgaaccgcaaaggttgaaactgcacacagccccggctaaacccatcgtggtccgcgatgagattgatcggccccaaccgcgactcgatcgtgatgcaggccgtgggatgagtattacggttggtcgcattatgccggacagcgtgcttgattatcgcttcatggcgctcggtcacaacacgattcgcggcgcggccggcgcggcgattctaaatgccgagttgctggtggcgcgaggatatttatga

SEQ ID NO: 106 - protein, 350 aa, Unknown
  Gene ID asd_12 sequence from unknown bacterial species from environmental sample
MSKKFRVGILGATGVVGQRFIQLLENHPQFEVAALAASDRSQGKSYVNACTWRLPGEMPEAVKNIIVQPPSPPLNCDFVFSSLPGEIARTAEEDFARAGYPVISNSSSHRMGLDIPLLIPEVNPDHLELIDAQRTNHEYNRGFIVTNPNCSAIAIVIALAPLHEKFGVSSCVVTTMQALSGAGYPGVPSLDATDNVIPFIGGEDEKVECETRKILGVVTQGAVVDADMTISAQCNRVNVTDGHMASIRVKLARSATLEEIREALVSFTAEPQRLKLHTAPAKPIVVRDEIDRPQPRLDRDAGRGMSITVGRIMPDSVLDYRFMALGHNTIRGAAGAAILNAELLVARGYL

SEQ ID NO: 107 - DNA, 1056 bp, Unknown
  Gene ID asd_13 sequence from unknown bacterial species from environmental sample
atgtccaacaaatttcgagtcggcattctcggtgcaaccggcatggtcggtcaacgattcgtccaactgctggagaatcatcccgtttttgaaatcacggcgctggcagcgtctgatcgttcgcaaggaaagacttacgccgcagcctgcacctggcgtttgccgggcgagatgccggctcgcgtgaaacagatcgtcgtgcagccgcccgccccgccactcgactgcgatttcgttttctccagtttgccgggcgagatcgcgactgatgccgagccgaaattcgcgcgaatggattttccagtgatcagtaattcttcatcgcatcgcatggcgcctgatgttcctctgctgattccggaagttaatcctgaacacgtcgaactgatcgacgcgcagcgcatcaaccgcgaatacaatcgcgggtttatcgtcaccaacccaaattgctcggcaattgtaatcgtgatggccctcgcaccgttgcacgcgaagtttggtgttgaatcgtgcatcgtcaccacgatgcaagcgctttccggggccggctatccgggggtggcttcgctggacgccaccgacaatgtgattccgttcatcagcggcgaggacgaaaaggtcgagagcgaaacgcgaaaaattctcggcgttgtcagccaaggtgagatcatcgatgccgacatgaaagtcagcgcccagtgcaaccgcgtgaatgtgaccgacggtcacctggcttcgattcgggtgaaactggcgcggccggcatctgcgaacgaatttcgcgatgcgctcgcatcgttcaccgccgagccccaaaagctgaaactgcacacggcgcctgcgaacccgctactcatccgcgatgaaatcgatcggccacagccgcgccttgatcgtgatgccgaaaatggaatgagtgtaaccgtggggaggattgctgaagataacgtgcttgattatcgcttcgtagcgctgggtcacaacacgattcgcggcgccgccggagcggcgattctgaatgcagagttgctggtggcgaaaggatatctcgcgtga

SEQ ID NO: 108 - protein, 351 aa, Unknown
  Gene ID asd_13 sequence from unknown bacterial species from environmental sample
MSNKFRVGILGATGMVGQRFVQLLENHPVFEITALAASDRSQGKTYAAACTWRLPGEMPARVKQIVVQPPAPPLDCDFVFSSLPGEIATDAEPKFARMDFPVISNSSSHRMAPDVPLLIPEVNPEHVELIDAQRINREYNRGFIVTNPNCSAIVIVMALAPLHAKFGVESCIVTTMQALSGAGYPGVASLDATDNVIPFISGEDEKVESETRKILGVVSQGEIIDADMKVSAQCNRVNVTDGHLASIRVKLARPASANEFRDALASFTAEPQKLKLHTAPANPLLIRDEIDRPQPRLDRDAENGMSVTVGRIAEDNVLDYRFVALGHNTIRGAAGAAILNAELLVAKGYLA

SEQ ID NO: 109 - DNA, 1092 bp, Unknown
  Gene ID asd_14 sequence from unknown bacterial species from environmental sample
atgaaggcccctaggcctgacaaacgtaaaccaagtatgaccaataaacttcgagttggaattctcggcgcaacgggaatggttgggcagcgctttatccaacttttggaaaaccatccgcaatttcagattacggcactggcagcgtcggatcgttcgcaaggtaaaacgttctcagaagcttgtacctggcgtttgcccggagagatgccctcgtttgttaagtcgatgccggttcacgccccaaaccccccgctggactgtgaattggtgttctccagtctgccgggtgagatcgcacgcgaaagcgaacaaagttttgtcaacgccggatttcccgtcatcagcaactcctccgcttttcggatggacgccaacgttcctttactgattccggaagttaatcctgagcatctgtcgttgcttgaattgcaacaaaaagaaagcaacggcaagcgcggatatattgttaccaacccaaattgttcgacgatcatgttggcgcttgcactcgccccgttgcatgcgcgcttcggtgtgcaaaacgttgtcgccaccaccttgcaggctttatcaggcgccggatacccgggcgttgcgtcgcttgccattagtgacaacgtgttgccgtttatcgaaggcgaggagcagaagatagagcaggaaacgttgaagattctcggcagcgtcgacggggaaacaattcggcacgcagcgatcagcgtgagcgcgcaatgcacgcgcgtgaacgtctcagacggccacatggccgcggtccgcgttaagctgattgagccggcgacaaaagatgaggttatagatgcactcgcttcgtttaccgcgctgccgcaaaaactgaatctccactccgcgccgccgcagccaatcatcgtgcgcaatgagtccgaccgtccgcagccacggcttgatcgagatgcgggcaaaggaatgagcattacgattggacgagtggaccatgaccacgtgatggactaccgctttttttctttgagtcacaacacagtccgaggcgctgccggcgcggcaatccttaacgctgaattgcttctggcgatggggaaaataagatga

SEQ ID NO: 110 - protein, 363 aa, Unknown
  Gene ID asd_14 sequence from unknown bacterial species from environmental sample
MKAPRPDKRKPSMTNKLRVGILGATGMVGQRFIQLLENHPQFQITALAASDRSQGKTFSEACTWRLPGEMPSFVKSMPVHAPNPPLDCELVFSSLPGEIARESEQSFVNAGFPVISNSSAFRMDANVPLLIPEVNPEHLSLLELQQKESNGKRGYIVTNPNCSTIMLALALAPLHARFGVQNVVATTLQALSGAGYPGVASLAISDNVLPFIEGEEQKIEQETLKILGSVDGETIRHAAISVSAQCTRVNVSDGHMAAVRVKLIEPATKDEVIDALASFTALPQKLNLHSAPPQPIIVRNESDRPQPRLDRDAGKGMSITIGRVDHDHVMDYRFFSLSHNTVRGAAGAAILNAELLLAMGKIR

SEQ ID NO: 111 - DNA, 1056 bp, Unknown
  Gene ID asd_15 sequence from unknown bacterial species from environmental sample
atgacaagtaaacttcgagttggaattctcggtgcgacgggaatggttgggcagcgctttatccaacttttggaaaaccatccgcaatttcaaattacggcactggcggcgtcagatcgttcgcaaggcaaaacatttgcagaagcgtgtacctggcgtttgcccggagagatgccctcgtttgtgaagtcgatgccggttcacgcgccaaagccgccgctggactgtgaattggtgttttccagtctgccgggcgaaatcgcacgcgaaagcgaacaaagttttgtcaacgccggatttcctgtcatcagcaactcctccgcttttcggatggacgccaacgttcctttactgattccggaagttaatccggagcatctgtcgttgcttgaattgcaacaaaaagaaggcaacggcaagcgcggttacattgttaccaacccaaactgttcgacgatcatgttggcgctggcactcgccccgttgcatgcgcgcttcggtgtgcgaaacgttgtcgccaccaccttgcaggctttatccggggccggattcccgggcgttgcgtcgcttgctattagtgacaacgtgttgccgtttatcgaaggcgaggagcagaagatagagcaggagacgttgaagattctcggcagcgtcgacggggaaacaattcgtcacgcagcgatcagtgtgagcgcgcaatgtacgcgcgtgaacgtttcagacggccatatggccgctgtgcgcgtcaagctggataagccggcgacaaaagatgaggttatcgatgcgctcgcgtcgtttaccgcgctgcctcaaaaattgaatctccactcggcgccgccgcagccaatcatcgtgcgtaatgagtccgaccgcccgcagcctcggcttgatcgagatgcgggcaaaggaatgagcattacgattggacgactggaccatgaccacgtgatggactaccgctttttttctttgagtcacaacacagtccgaggcgctgccggtgcggcaatccttaacgctgaattgcttctggcgatggggaaaataggatga

SEQ ID NO: 112 - protein, 351 aa, Unknown
  Gene ID asd_15 sequence from unknown bacterial species from environmental sample
MTSKLRVGILGATGMVGQRFIQLLENHPQFQITALAASDRSQGKTFAEACTWRLPGEMPSFVKSMPVHAPKPPLDCELVFSSLPGEIARESEQSFVNAGFPVISNSSAFRMDANVPLLIPEVNPEHLSLLELQQKEGNGKRGYIVTNPNCSTIMLALALAPLHARFGVRNVVATTLQALSGAGFPGVASLAISDNVLPFIEGEEQKIEQETLKILGSVDGETIRHAAISVSAQCTRVNVSDGHMAAVRVKLDKPATKDEVIDALASFTALPQKLNLHSAPPQPIIVRNESDRPQPRLDRDAGKGMSITIGRLDHDHVMDYRFFSLSHNTVRGAAGAAILNAELLLAMGKIG

SEQ ID NO: 113 - DNA, 1062 bp, Unknown
  Gene ID asd_16 sequence from unknown bacterial species from environmental sample
atgactgaaaaacttcgcgtaggaatacttggcgccactggaatggtcggtcagcgcttcattcaactgctggagaatcatccgcagtttgaaattacggcgctcgctgcttcggatcgttcgcagggcaaaactttcgaagaagcttgcacctggcgcctggccggtgaaatgcctgcgctcgttaagtcaatgcaggttcatgcgcccaagccgccgctcgaatgtcaactggtgttctccagcttgccgggagacattgcgcgtgattgcgaaggaagttttgtagcggccggcgtgcctgtgattagcaactcgtctgccttccgcatggaccagaatgttcccctgctgatcccggaagtaaatcccgagcatctgtcgctgttggatttgcaacaaagagacagcaacggaaaatccggatccggattcatagttactaatccaaattgttcgaccatcatgttggcaatgtccctcgcgccgttgcataaacgcttcggtgtaaagagtgtcgtggcgacgactatgcaggctttgtccggcgcaggatatccgggggttgcatcactggccatcagtgacaacgtcctcccgtacatcgacggcgaagaggaaaagatcgaacaggagactttgaagattctcggtcgtttagacggcgggcaaatacatgatgcgccaatgaatgtcagcgctcaatgcaatcgagtgaatgtctctgacggccacatggcagcggttcgggtgaagctggagaaggaggcgacgaaggaggaagtcagcgatgcgctggcgtctttcacagcactgccacaggaacttggtctccattcagctcccgaacggccgatcattgttcgtaatgaacctgaccggccccagccgcgtttggatcgggacgcgggcaacggaatgagcgtcacgattggacgcctgcaagaagatcgcgtgctcgactatcgcttcgtttctttaagtcacaacaccataagaggtgcggccggcgctgctattctcaacgcggaactacttatcgcctcaggattattgttatga

SEQ ID NO: 114 - protein, 353 aa, Unknown
  Gene ID asd_16 sequence from unknown bacterial species from environmental sample
MTEKLRVGILGATGMVGQRFIQLLENHPQFEITALAASDRSQGKTFEEACTWRLAGEMPALVKSMQVHAPKPPLECQLVFSSLPGDIARDCEGSFVAAGVPVISNSSAFRMDQNVPLLIPEVNPEHLSLLDLQQRDSNGKSGSGFIVTNPNCSTIMLAMSLAPLHKRFGVKSVVATTMQALSGAGYPGVASLAISDNVLPYIDGEEEKIEQETLKILGRLDGGQIHDAPMNVSAQCNRVNVSDGHMAAVRVKLEKEATKEEVSDALASFTALPQELGLHSAPERPIIVRNEPDRPQPRLDRDAGNGMSVTIGRLQEDRVLDYRFVSLSHNTIRGAAGAAILNAELLIASGLLL

SEQ ID NO: 115 - DNA, 1056 bp, Unknown
  Gene ID asd_17 sequence from unknown bacterial species from environmental sample
atgaccaagaagtttcgcgtaggaatactcggtgcgaccggcatggttgggcagcgctttatccagttgttggaggaccatccgcaatttgagataacggcgctggccgcgtcggatcgttcgcagggcaagacttttcaggaggcatgcacctggcgtttggccggggaaatgcccacctttgtgaaatcgatgaaggttgcggcgccgcaaccgccccttgattgcgagttgatcttttccagtttgcctggtgacatcgcgcgtcggagtgaagacgcctttgcccgggctggttttccagtaattagtaattcttcagcttttcggatggaccgcgacgtacctttactgattccggaagtaaaccacgagcatcttgctctgcttgatgtgcaacgaaagcagcgaggcgggcaacagggatacatcgtcacgaatccaaactgctccacaatcatgctggccctggcgttggcgccgctacacgcaaaatttggtgtgacgagtgtgatcgctactaccatgcaggcgttgtcaggcgcaggttatcccggtgttgcttcacttgccatcagcgataacgttttgccattcatcgacggcgaggaagaaaagatcgaacaggagacattgaagatcctgggcaaggtcaatggcgcgagcattgaagccgcgccaatgaatgtaagcgcacaatgtcaccgcgtgaatgtttcagacggccacatggcggcggtgcgagtgaaacttcaccagcccgcgaccatccatgaactaagtgctgcgctcagttcttttagcgcactgccgcagaagctaaagcttcattcagcgcctgagcacccgattattgtgcgcgaagaagtggatcgtccgcagccgcggctggatcgggatgcgggaaatggaatgagcgtcaccgtcggccgtttacaacccgacaacgtgtttgactaccggttcgttactcttagccacaacaccatacgcggcgcagctggcgctgcaattctcaatgcggaattattgatcgctagcggaaagctaacatga

SEQ ID NO: 116 - protein, 351 aa, Unknown
  Gene ID asd_17 sequence from unknown bacterial species from environmental sample
MTKKFRVGILGATGMVGQRFIQLLEDHPQFEITALAASDRSQGKTFQEACTWRLAGEMPTFVKSMKVAAPQPPLDCELIFSSLPGDIARRSEDAFARAGFPVISNSSAFRMDRDVPLLIPEVNHEHLALLDVQRKQRGGQQGYIVTNPNCSTIMLALALAPLHAKFGVTSVIATTMQALSGAGYPGVASLAISDNVLPFIDGEEEKIEQETLKILGKVNGASIEAAPMNVSAQCHRVNVSDGHMAAVRVKLHQPATIHELSAALSSFSALPQKLKLHSAPEHPIIVREEVDRPQPRLDRDAGNGMSVTVGRLQPDNVFDYRFVTLSHNTIRGAAGAAILNAELLIASGKLT

SEQ ID NO: 117 - DNA, 1068 bp, Unknown
  Gene ID asd_18 sequence from unknown bacterial species from environmental sample
atgtccaaagtccaaagtcaaaaaaaacttcgagtcggaatactgggcgcgactgggatggttggtcagcgcttcattcagttactggagaaccatccgcagtttgagataaccgcgcttgctgcttcggatcgttcacaaggaaaaacttttcaggaagcatgcacgtggcgactcgcaggcgaaatgccggcgaatgtccgatcgatgaaagtggccgctccagaagcgccgctcgattgcgacctcgtcttctcgagtttgccgggcgacatcgcacgaaggagcgaagcatcgttcgcgcgcgcaggttttccagtaattagtaattcttcagcttttcgtatggaccaggatgtgccgttgctgattccggaagtgaatcacgagcatctctctttgattgagacacaactaagaaaccacaacgggcagcaaggttacgtggtcacaaatccaaattgctcgacaatcatgctcgcgctcgcgctggcgccacttcatgaggcctttggtgtaaccagtgtaattgcaaccacgatgcaggcgctgtcaggagcgggttatccgggagtggcatcgctcgcgattagcgacaacgttctaccgttcattgacggtgaagaagaaaagatcgaacaggagacacggaagattctggggcgatttaaccaggacacggttgacaacgcgccgatgaacgtcagcgcccagtgcaatcgcgttaacgtttcggatggtcacatggcggcggtgcgagtgaaactgcaagagcctgcgaagctcgaagaagtgtctgaagccctcgcttcgtttaccgcgctgccgcaagagttgaaactccactccgctcctgagcagccgatcatcttgcgacaggaaacggatcgaccgcagccgcgcctcgatcgtgatgcaggaaacggaatgagtgtgactattggtcgcctgcagccagacaacgtacttgattatcggttcgttgcgctgagtcacaacacgattcgtggcgctgcgggtgctgccatcctgaatgctgaacttatgattgcaatgaagaggttgtaa

SEQ ID NO: 118 - protein, 355 aa, Unknown
  Gene ID asd_18 sequence from unknown bacterial species from environmental sample
MSKVQSQKKLRVGILGATGMVGQRFIQLLENHPQFEITALAASDRSQGKTFQEACTWRLAGEMPANVRSMKVAAPEAPLDCDLVFSSLPGDIARRSEASFARAGFPVISNSSAFRMDQDVPLLIPEVNHEHLSLIETQLRNHNGQQGYVVTNPNCSTIMLALALAPLHEAFGVTSVIATTMQALSGAGYPGVASLAISDNVLPFIDGEEEKIEQETRKILGRFNQDTVDNAPMNVSAQCNRVNVSDGHMAAVRVKLQEPAKLEEVSEALASFTALPQELKLHSAPEQPIILRQETDRPQPRLDRDAGNGMSVTIGRLQPDNVLDYRFVALSHNTIRGAAGAAILNAELMIAMKRL

SEQ ID NO: 119 - DNA, 1044 bp, Unknown
  Gene ID asd_19 sequence from unknown bacterial species from environmental sample
atgactagaaaacttcgtgtgggaatacttggcgctaccgggatggtggggcaacgctttattcaactgctggagaatcatccccagtttgagatcacagcattggctgcatctgatcgatcgcaggggaaggcttttcaggaggcttgtacctggcgtcttgcaggagagatgcctgagtttgtgaagtcaatgccgatcgcggcgccgcaacctccgctggattgcgaattagttttctcgagtttgccgggcgacatcgcgcgtcaaagtgaaggtgcctttgccgaggcgggctttcctgtgatcagcaactcatcagcgtatcggatggaccagcacgttcccttactaattcccgaggtgaaccatcaacatctcgcgctgctcgagtcacaacagcagaagggcttcatcgtcactaacccaaactgttcgacgatcatgctggcgttggccctcgcgccgctacatgcgaggtttcgcgtgaccagcgtcatcgccacaactctccaggcattatcgggcgccggttatcccggggttccgtcgctggccattagtgacaatgttctgccattcatcgatggtgaagaggaaaagatcgagaaggaaacactcaagattctcgggccaatcgaaaaaggacatctcatcgacgcgccgatgaaggtgagcgcacagtgtcatcgggtgaatgtctctgacggacacatggccgcagtgcgagtgaagttggataagttgactacgattgaagaagtgagtgaagcatttgcttcctttagttcgctgccacaggaactaaaactgcactcagcaccagagaagccaatcgttgtgctgcaagaacccgatcgtcctcagccgcgcctcgatcgagatgccggaaaggggatgagcgttacagttggtcgcttgcgagacgataacgtgcttgactaccgattcgtggcgctcagccacaacacgatcagaggcgccgcgggagctgcgattctcaatgcggagctgctgattgcgagtggatacttagggaaataa

SEQ ID NO: 120 - protein, 347 aa, Unknown
  Gene ID asd_19 sequence from unknown bacterial species from environmental sample
MTRKLRVGILGATGMVGQRFIQLLENHPQFEITALAASDRSQGKAFQEACTWRLAGEMPEFVKSMPIAAPQPPLDCELVFSSLPGDIARQSEGAFAEAGFPVISNSSAYRMDQHVPLLIPEVNHQHLALLESQQQKGFIVTNPNCSTIMLALALAPLHARFRVTSVIATTLQALSGAGYPGVPSLAISDNVLPFIDGEEEKIEKETLKILGPIEKGHLIDAPMKVSAQCHRVNVSDGHMAAVRVKLDKLTTIEEVSEAFASFSSLPQELKLHSAPEKPIVVLQEPDRPQPRLDRDAGKGMSVTVGRLRDDNVLDYRFVALSHNTIRGAAGAAILNAELLIASGYLGK

SEQ ID NO: 121 - DNA, 1056 bp, Unknown
  Gene ID asd_20 sequence from unknown bacterial species from environmental sample
atgacgagaaaacggcgagttggaattttgggtgcaaccgggatggtcggccagcgttttattcaattgctggagaaccatccgcaatttgaaatcaccgcgctggctgcttcggatcgttcacaaggcaaaacctttcaacacgcatgcacgtggcgactggccggcgacatgcctgagtttgtgaaacagatggaggtccaggcgccgcaaccgccgctcgattgtgatctggtcttctcgagtttgcctggcgacatcgctcgcgagagtgaaggaaggtttgcggatgcgggttatccggtgatcagcaactcatctgcgtaccggatggacgcggacgttcctctgttaatacctgaagtgaatcacgcgcatctcgatctgctcaaggttcagcgccggcaaccaaaccggcaacgcggcttcatcgtcacgaatccaaattgttcgacgatcatgctggcgttggcactcgcacccttgcacgcgaattttggcgtcacgagcgcggtggcgacgacgatgcaggctttgtccggcgccggttatccgggcgtcgcatcactcgccatcagcgacaacgtgttgccgttcatcgaaggtgaagaagaaaaaatcgaacaggagactttaaagattctgggccaactcaacggtgaaaggatcgtggaggcttccatgaacgtgagcgcgcaatgtcaccgcgtgaatgtttccgacggacatctcgctgcggttcgcgtaaagctaaacagacaggcgacaaaagatgagttggttgaagcgcttgcttcgttcaagtcgctgcctcaggaattacaacttcactcggcgccggagcacccgatcattgttcgcaatgagcccgaccgtccgcagccgcgtttggatcgagaggcgggcaacggcatgagcgtcaccatcggacggttacaggatgacaacgtgctcgactatcgctttgtcgctctcagccacaacacaattcgcggcgcagcaggcgccgccattctcaacgctgaactcctcgtcgcttcgggattattgacatga

SEQ ID NO: 122 - protein, 351 aa, Unknown
  Gene ID asd_20 sequence from unknown bacterial species from environmental sample
MTRKRRVGILGATGMVGQRFIQLLENHPQFEITALAASDRSQGKTFQHACTWRLAGDMPEFVKQMEVQAPQPPLDCDLVFSSLPGDIARESEGRFADAGYPVISNSSAYRMDADVPLLIPEVNHAHLDLLKVQRRQPNRQRGFIVTNPNCSTIMLALALAPLHANFGVTSAVATTMQALSGAGYPGVASLAISDNVLPFIEGEEEKIEQETLKILGQLNGERIVEASMNVSAQCHRVNVSDGHLAAVRVKLNRQATKDELVEALASFKSLPQELQLHSAPEHPIIVRNEPDRPQPRLDREAGNGMSVTIGRLQDDNVLDYRFVALSHNTIRGAAGAAILNAELLVASGLLT

SEQ ID NO: 123 - DNA, 1053 bp, Unknown
  Gene ID asd_21 sequence from unknown bacterial species from environmental sample
atggctaaacgacgcgtaggaatattgggcgccaccggcatggtgggacagcgattcattcaactgctcgaggaccacccgcagtttgaaatcacagcgctggccgcatcagatcgatctcaaggcaggacttttgccgacgcttgtacatggcgacttcctggcgagatgccggcgtttgtccgctcaatgatcgtccaggcgccggcgccaccgctcgattgcgaattggtgttttcgagtttgccgggcgacattgcccgctcgagcgaagggatgtttgctgatgccggttatcccgtgattagcaactcgtcagccttccgcatggatgcggatgttcctttactgattcccgaagtcaacaactcgcatctggatctgctcgcggtccaacgaaacaagtccaaccgtcaacgcggctttatcgttacaaatcccaactgttcaacgatcatgttagcccttgctctggcgccgctgcatttcaagttcggcgtcagcaacgtcgttgccactactctacaggcgctctcaggcgccggatatcccggagtcgcgtcgctggcaatcagtgacaatgttcttccttttattgacggggaggaggagaagatcgagaaagaaacgctcaaaatcctgggccacgttcaaaaaggcaccattgcggaagcctcgatgaatgtgagcgcccaatgccatcgtgtcaatgtcactgatggacatatggcagcagtgcgggtgaagttgaatcagttagctaccactgaagatgtcgcgcaaacgctggcatcgttccgtgcgttgccccaggaattgcatcttcattccgcgccggagcatccaatcgttgtgcgcaatgaacctgatcggccgcagccgcggcttgatcgagatgcgggaaacggaatgagtgtaacgatcggtcgaatccaacccgataatgtacttgactaccggttcgttgcccttagccacaatacaatccgcggcgctgccggcgccgccattctcaatgccgaacttctgatcgcgtccggaatacttatatga

SEQ ID NO: 124 - protein, 350 aa, Unknown
  Gene ID asd_21 sequence from unknown bacterial species from environmental sample
MAKRRVGILGATGMVGQRFIQLLEDHPQFEITALAASDRSQGRTFADACTWRLPGEMPAFVRSMIVQAPAPPLDCELVFSSLPGDIARSSEGMFADAGYPVISNSSAFRMDADVPLLIPEVNNSHLDLLAVQRNKSNRQRGFIVTNPNCSTIMLALALAPLHFKFGVSNVVATTLQALSGAGYPGVASLAISDNVLPFIDGEEEKIEKETLKILGHVQKGTIAEASMNVSAQCHRVNVTDGHMAAVRVKLNQLATTEDVAQTLASFRALPQELHLHSAPEHPIVVRNEPDRPQPRLDRDAGNGMSVTIGRIQPDNVLDYRFVALSHNTIRGAAGAAILNAELLIASGILI

SEQ ID NO: 125 - DNA, 1044 bp, Unknown
  Gene ID asd_22 sequence from unknown bacterial species from environmental sample
atgactaaaaaacttcgtgtgggaatactcggtgccacgggcatggttggccagcgcttcattcaactgctggagaatcacccgcaattcgagattacagcgctggcggcctctgatcgatcgcagggcaagacttttcaggaagcctgcacgtggcgtctcgctggagagatgccggaattcgtgaagtcaatgccgatcgcggcgccgcagccaccgctcgattgcgaactggtattttcaagtttgcccggtgaaatcgcacgcgagagtgaaggagcttttgccgcggcgggatttccggtcattagtaactcttcggcgtatcgcatggacgctgacgttccgctgctgattcccgaagtgaatcatccacaccttgcgctggtcgagttgcaacagcggaagggcttcatcgtcactaatccaaactgttccacgatcatgttggcgctggtgctggcgccgctccatgcaaagtttcgcgtgaccagcgtagtcgcgacaactctgcaggcactatcgggcgctggttatccgggagttccctcgctggccattagtgataatgttttgccgttcatcgacggtgaagaggaaaagattgagcaggaaacgctgaagattcttggctcgatagaagaaggacatatcatcgacgcccccatacaggtgagtgcgcagtgtcaccgggtaaatgtttcagacggacacatggcggcggtgcgcgtgaagctcgatcagttaactacaatcgaagaagtcagtgaaacatttgcttccttcacctcgctcccgcaggaactaaaactgcactcggcgccggagcagcctattattgtggtgcatgaacatgatcgtcctcagccgcgcctggatcgagatgcgggaagcgggatgagcgtcaccgttggccgagtgcgcgaggataatgtgctcgactatcgcttcgttgcgctaagccacaacacgatcagaggcgcagccggcgccgcgattctcaatgcggaattgctaattgcgagtggatacctccagaagtga

SEQ ID NO: 126 - protein, 347 aa, Unknown
  Gene ID asd_22 sequence from unknown bacterial species from environmental sample
MTKKLRVGILGATGMVGQRFIQLLENHPQFEITALAASDRSQGKTFQEACTWRLAGEMPEFVKSMPIAAPQPPLDCELVFSSLPGEIARESEGAFAAAGFPVISNSSAYRMDADVPLLIPEVNHPHLALVELQQRKGFIVTNPNCSTIMLALVLAPLHAKFRVTSVVATTLQALSGAGYPGVPSLAISDNVLPFIDGEEEKIEQETLKILGSIEEGHIIDAPIQVSAQCHRVNVSDGHMAAVRVKLDQLTTIEEVSETFASFTSLPQELKLHSAPEQPIIVVHEHDRPQPRLDRDAGSGMSVTVGRVREDNVLDYRFVALSHNTIRGAAGAAILNAELLIASGYLQK

SEQ ID NO: 127 - DNA, 1050 bp, Unknown
  Gene ID asd_23 sequence from unknown bacterial species from environmental sample
atgactaaaaaacttcgtgtgggaatacttggcgctaccggcatggttggccagcgcttcattcaattgctggaaaatcatccgcaatttgagattacagcgctggcggcttctgatcgatcgcagggcaagacttttcaggaagcctgcacgtggcgtctcgctggagagatgcctgaattcgtaaagtcgatgccgatcgcggcgccacagcccccgctcgattgcgaactagtattttccagtttgcccggtgacatcgcacgcgagagtgagggagcttttgccgcggcgggatttcccgtcatcagcaactcttcggcttatcgcatggacgctgacgttccactgctgattcccgaagtgaatcatccacacctcgcgctcctcgactcacaacgtcagcagcggaagggcttcatcgtcactaatccaaactgttccacaatcatgttggcgatggcgctggcgccgctccatgcaaagtttcgcgtgaccagcgttatcgcgacgacgctccaggcactatcgggcgccggttatccgggcgttccctcgctggccatcagtgataatgttttgccgttcatcgatggtgaagaagaaaagatcgagcaggaaacgttgaagattcttggaccaatgaaagaaggacgtataagcgccgcctctatgcaggtgagcgcgcagtgtcatcgggtaaatgtttcagacgggcacatggcggcggtgcgcgtgaagctcgatgagttaactacaatcgaagaagtctttgaagcatttgcttccttcaccgcgctcccgcaggaactaaaactgcactcggcgccggagcagccgatcattgtggtgcatgagcctgatcgtcctcagccgcgacttgatcgagatgcaggaagcggaatgagcgtcacagttggccgcgtgcgtgaggataacgtgctcgactatcgcttcgttgcgctaagccacaacacgatcagaggcgcagccggcgcagcgattctcaatgcggaattgttgatcgcgaaaggatatttagggcattaa

SEQ ID NO: 128 - protein, 349 aa, Unknown
  Gene ID asd_23 sequence from unknown bacterial species from environmental sample
MTKKLRVGILGATGMVGQRFIQLLENHPQFEITALAASDRSQGKTFQEACTWRLAGEMPEFVKSMPIAAPQPPLDCELVFSSLPGDIARESEGAFAAAGFPVISNSSAYRMDADVPLLIPEVNHPHLALLDSQRQQRKGFIVTNPNCSTIMLAMALAPLHAKFRVTSVIATTLQALSGAGYPGVPSLAISDNVLPFIDGEEEKIEQETLKILGPMKEGRISAASMQVSAQCHRVNVSDGHMAAVRVKLDELTTIEEVFEAFASFTALPQELKLHSAPEQPIIVVHEPDRPQPRLDRDAGSGMSVTVGRVREDNVLDYRFVALSHNTIRGAAGAAILNAELLIAKGYLGH

SEQ ID NO: 129 - DNA, 1050 bp, Unknown
  Gene ID asd_24 sequence from unknown bacterial species from environmental sample
atgactaaaaaacttcgtgtgggaatacttggcgctaccggcatggttggccagcgcttcattcaattgctggaaaatcatccgcaatttgagattacagcgctggcggcttctgatcgatcgcagggcaagacttttcaggaagcctgcacgtggcgtctcgctggagagatgcctgaattcgtaaagtcgatgccgatcgcggcgccgcagccgccgctcgattgcgagctagtattttccagtttgcccggtgacatcgcacgcgagagtgagggagcttttgccgcggcgggatttcccgtcatcagcaactcttcggcttatcgcatggacgctgaggttccactgctgattcccgaagtgaatcatccacacctcgcgctcctcgactcacaacgtcagcagcggaacggcttcatcgtcactaatccaaactgttccacaatcatgttagcgatggcgctggcgccgctccatgcaaagtttcgcgtgaccagcgttatcgcgacgacgctccaggcactatcgggcgccggttatccgggcgttccctcgctggccatcagtgataatgttttgccgttcatcgatggtgaagaagaaaagatcgagcaggaaacgttgaagattcttggaccaatgaaagaaggacgtataagcgccgcctctatgcaggtgagcgcgcagtgtcatcgggtaaatgtttcagacgggcacatggcggcggtgcgcgtgaagctcgatgagttaactacaatcgaagaagtcagtgaagcatttgcttccttcaccgcgctcccgcaggaactaaaactgcactcggcgccggagcagccgatcattgtggtgcatgagcctgatcgtcctcagccgcgacttgatcgagatgcaggaagcggaatgagcgtcacagttggccgcgtgcgtgaggataacgtgctcgactatcgcttcgttgcgctaagccacaacacgatcagaggcgcagccggcgcagcgattctcaatgcggaattgttgatcgcgaaaggatatttagggcattaa

SEQ ID NO: 130 - protein, 349 aa, Unknown
  Gene ID asd_24 sequence from unknown bacterial species from environmental sample
MTKKLRVGILGATGMVGQRFIQLLENHPQFEITALAASDRSQGKTFQEACTWRLAGEMPEFVKSMPIAAPQPPLDCELVFSSLPGDIARESEGAFAAAGFPVISNSSAYRMDAEVPLLIPEVNHPHLALLDSQRQQRNGFIVTNPNCSTIMLAMALAPLHAKFRVTSVIATTLQALSGAGYPGVPSLAISDNVLPFIDGEEEKIEQETLKILGPMKEGRISAASMQVSAQCHRVNVSDGHMAAVRVKLDELTTIEEVSEAFASFTALPQELKLHSAPEQPIIVVHEPDRPQPRLDRDAGSGMSVTVGRVREDNVLDYRFVALSHNTIRGAAGAAILNAELLIAKGYLGH

SEQ ID NO: 131 - DNA, 1353 bp, Clostridiales sp.
atgtccaagtacgttgaccgcgtcattgctgaagtcgagaaaaagtacgccgacgaaccggaattcgttcaaaccgttgaagaggtactctcttcactcggcccagtagtcgacgcacaccccgagtatgaagaggttgcgctcttggagcgtatggtcattccagaacgtgtcattgagtttcgcgtcccgtgggaggatgacaatggtaaagtacatgtgaatactggttaccgcgtccaatttaatggcgcgatcggcccttataaaggtggcttgcgcttcgccccttcggtcaacctttccattatgaaatttctcggcttcgagcaagcattcaaagattccctgaccacgcttcctatgggaggagcaaaaggcggttcagacttcgacccaaacggaaaatccgatcgcgaagtaatgcgcttctgccaggcgttcatgactgagttgtatcggcatattggtcccgatatcgacgtgcctgctggtgacttgggcgttggtgcgcgtgaaattggttacatgtacggacaataccggaagatcgtcggcggattctacaatggcgtcctgaccggtaaagcccggtcattcggtggaagcttggtccggcccgaagcaactggttacggatcggtgtattatgtggaggctgtgatgaaacatgaaaatgacacgcttgtaggtaaaactgttgcactggcaggttttggtaacgttgcatggggtgcagctaagaagctcgcggagttgggtgcgaaagcagtaactttgtctggcccggatggctatatctacgaccccgagggtatcactaccgaggaaaagatcaattacatgcttgaaatgcgggcgtctggacgtaacaaggtacaggattacgcagacaagtttggagtgcaattctttccgggtgaaaagccttggggccaaaaagttgacattattatgccttgtgcaactcagaatgatgttgacctggaacaggctaaaaagatcgtggcgaacaacgtgaagtactacatcgaagtagccaacatgcctactactaatgaagcattgcggtttcttatgcagcaacctaacatggtagtcgcccccagcaaggctgtgaacgcaggtggagtactggtatcgggtttcgagatgtcacaaaattccgaacgtctgtcatggaccgccgaagaagtcgatagcaaactgcatcaggtgatgactgacattcatgacggttcagccgccgcagctgaacgctacggacttggttacaatcttgtcgcaggtgctaatatcgtaggttttcagaagatcgccgatgccatgatggctcaaggaatcgcttggtag

SEQ ID NO: 132 - protein, 450 aa, Clostridiales sp.; identical to SEQ ID NO: 44

SEQ ID NO: 133 - DNA, 1344 bp, Escherichia coli
atggatcagacatattctctggagtcattcctcaaccatgtccaaaagcgcgacccgaatcaaaccgagttcgcgcaagccgttcgtgaagtaatgaccacactctggccttttcttgaacaaaatccaaaatatcgccagatgtcattactggagcgtctggttgaaccggagcgcgtgatccagtttcgcgtggtatgggttgatgatcgcaaccagatacaggtcaaccgtgcatggcgtgtgcagttcagctctgccatcggcccgtacaaaggcggtatgcgcttccatccgtcagttaacctttccattctcaaattcctcggctttgaacaaaccttcaaaaatgccctgactactctgccgatgggcggtggtaaaggcggcagcgatttcgatccgaaaggaaaaagcgaaggtgaagtgatgcgtttttgccaggcgctgatgactgaactgtatcgccacctgggcgcggataccgacgttccggcaggtgatatcggggttggtggtcgtgaagtcggctttatggcggggatgatgaaaaagctctccaacaataccgcctgcgtcttcaccggtaagggcctttcatttggcggcagtcttattcgcccggaagctaccggctacggtctggtttatttcacagaagcaatgctaaaacgccacggtatgggttttgaagggatgcgcgtttccgtttctggctccggcaacgtcgcccagtacgctatcgaaaaagcgatggaatttggtgctcgtgtgatcactgcgtcagactccagcggcactgtagttgatgaaagcggattcacgaaagagaaactggcacgtcttatcgaaatcaaagccagccgcgatggtcgagtggcagattacgccaaagaatttggtctggtctatctcgaaggccaacagccgtggtctctaccggttgatatcgccctgccttgcgccacccagaatgaactggatgttgacgccgcgcatcagcttatcgctaatggcgttaaagccgtcgccgaaggggcaaatatgccgaccaccatcgaagcgactgaactgttccagcaggcaggcgtactatttgcaccgggtaaagcggctaatgctggtggcgtcgctacatcgggcctggaaatggcacaaaacgctgcgcgcctgggctggaaagccgagaaagttgacgcacgtttgcatcacatcatgctggatatccaccatgcctgtgttgagcatggtggtgaaggtgagcaaaccaactacgtgcagggcgcgaacattgccggttttgtgaaggttgccgatgcgatgctggcgcagggtgtgatttaa

SEQ ID NO: 134 - protein, 447 aa, Escherichia coli
MDQTYSLESFLNHVQKRDPNQTEFAQAVREVMTTLWPFLEQNPKYRQMSLLERLVEPERVIQFRVVWVDDRNQIQVNRAWRVQFSSAIGPYKGGMRFHPSVNLSILKFLGFEQTFKNALTTLPMGGGKGGSDFDPKGKSEGEVMRFCQALMTELYRHLGADTDVPAGDIGVGGREVGFMAGMMKKLSNNTACVFTGKGLSFGGSLIRPEATGYGLVYFTEAMLKRHGMGFEGMRVSVSGSGNVAQYAIEKAMEFGARVITASDSSGTVVDESGFTKEKLARLIEIKASRDGRVADYAKEFGLVYLEGQQPWSLPVDIALPCATQNELDVDAAHQLIANGVKAVAEGANMPTTIEATELFQQAGVLFAPGKAANAGGVATSGLEMAQNAARLGWKAEKVDARLHHIMLDIHHACVEHGGEGEQTNYVQGANIAGFVKVADAMLAQGVI

SEQ ID NO: 135 - DNA, 1377 bp, Unknown
  Gene ID gdh_1 sequence from unknown bacterial species from environmental sample
ttgaaatcattaaacgaaaattccgtcaacggcctggcccgcataaaaagtattactgacttcgtcgtcgatctcgaaaaacgcaatccgcacgagcccgagttcaaacaggccgtaactgaagcggtcaacgatctcattccattcatcgaagccaatccacgttatcagaaccagatgattctcgagcggctcaccgaacccgatcgcgtcattactttccgcgtttcctggatggacgatgccgggaacattcgcatcaatcgcggctatcgcgtgcagaacagcaatgcaatcggcccgtacaaaggcggcattcgttttcacccgagcgtgaatctcagcatcctgaaatttctcgcgtttgaacaaaccctgaaaaacagtttgactggcctgccgatgggcggcgcgaaaggcggctccgatttcgatcccaaaggaaaatccgatgcggaagtcatgcgcttctgccaggcgctgatcaccgaactctggcgtcacatcggttccgataccgacgtaccggcaggtgacataggcgtaggagcacgcgaagtcggctacatgttcggccaatacaaacgtctttccaattcgttcacaggtgcgttcaccggcaagggcatcgactacggcggcagtctcggccgcaccgaagccaccggttacggcgctgtgtatatgcttgcggaagtcatgacgtacaacaaggaagacctcgcgggcaaacgcgtgctcgtttccggttcgggcaatgtggcggtatatgcggttgaaaaagccatgcagatgggagcgatcgtcaccacgctctcagactccagcggcttcgtctacgacaagaatggcttcacttacgaaaaactcgaatacatcaaacagctgaaattcatcgaccgcggccgcatcgaaaaatattgcgatcatttcgaagccgaattccacgccggcaggaaaccctggggaatgcctgccgatgtcgcgctgccctgtgcaacgcagaacgaaatcacgctcgacgatgccaaaaccctcgtcgccaacggctgcagatatctcgtggaaggcgccaacatgcccaccaccatcgacgcgattgcattgttactcgaaaacaaagtgcattacgtccccggcaaagcagccaacgccggcggtgtggcagtgtcaggcctcgagatgagccagaactcgctgcgcatcggctggaccgcacgagaggtcgatctcaaactgcacgacatcatgcgtcacatccatcacaagtgcgtgcagcacggcaaggaaaatggtttcgtcaattattcaaaaggcgccaacattgccggtttcatcaaggtggcggatgcgatgctcgcgttgggcgttgtttag

SEQ ID NO: 136 - protein, 458 aa, Unknown
  Gene ID gdh_1 sequence from unknown bacterial species from environmental sample
LKSLNENSVNGLARIKSITDFVVDLEKRNPHEPEFKQAVTEAVNDLIPFIEANPRYQNQMILERLTEPDRVITFRVSWMDDAGNIRINRGYRVQNSNAIGPYKGGIRFHPSVNLSILKFLAFEQTLKNSLTGLPMGGAKGGSDFDPKGKSDAEVMRFCQALITELWRHIGSDTDVPAGDIGVGAREVGYMFGQYKRLSNSFTGAFTGKGIDYGGSLGRTEATGYGAVYMLAEVMTYNKEDLAGKRVLVSGSGNVAVYAVEKAMQMGAIVTTLSDSSGFVYDKNGFTYEKLEYIKQLKFIDRGRIEKYCDHFEAEFHAGRKPWGMPADVALPCATQNEITLDDAKTLVANGCRYLVEGANMPTTIDAIALLLENKVHYVPGKAANAGGVAVSGLEMSQNSLRIGWTAREVDLKLHDIMRHIHHKCVQHGKENGFVNYSKGANIAGFIKVADAMLALGVV

SEQ ID NO: 137 - DNA, 1569 bp, Unknown
  Gene ID gdh_2 sequence from unknown bacterial species from environmental sample
cagtgtcttgatgcacaggaatggggcccttggtggccccatttttgtgcctgccgtttacgggtgtggctgtttgaaggccagtattgcggctgtttttgtatacacttatataaaacgcaccaaataaattcagaaaaacgacatatcgccctgttccggtgcgattgcttcttggtacattcccgaaaaaccaataagtccaaaatcttcggtgagatgtctaccatgatcgaatctgtcgacagtttcctcgcgcgcctgcaacagcgcgacccaggccagcctgagtttcatcaggcagtggaagaagtgctgcgcacgctgtggcccttcctggaagccaaccctcattacctgcagtccggcatcctggagcgtatggtcgagccggagcgtgcggtgctgtttcgcgtgtcgtgggtcgatgaccagggcaaagtgcaggtcaaccgcggctaccgtatccagatgagcagcgccatcggcccgtacaagggcggcttgcgcttccacccctcggtcaacctcagcgtgctgaaattcctggccttcgagcaggtcttcaagaactccctgacttcgctgcccatggggggtggcaagggcgggtcggacttcgaccccaaaggcaagagcgacgccgaagtgatgcgcttctgccaggcgttcatgagcgagctgtaccgccacatcggcgccgactgcgacgtgccggccggtgacatcggcgtgggtgcccgcgaaatcggcttcatgtttggccagtacaagcggcttgccaaccagttcacgtcggtactgaccggcaaggggatgacctacggtggcagcctgattcgccccgaagccaccggctacggttgcgtgtatttcgccgaggaaatgctcaagcgccaggacaagcgcatcgacggccgtcgcgtggcggtgtcgggctcgggcaacgttgcccagtatgccgcgcgcaaggtcatggacctgggcggcaaagtgatctccatgtcggactccgaaggcacgctgtatgccgaagccggcctgaccgatgcccagtgggaagcactgatggcgctgaagaacgtcaagcggggccgtatcagcgagctggccgagcagttcggcctggagttccgcaagggccagaccccttggagcctggcatgcgacatcgccttgccgtgcgccacgcagaatgaactgggcgccgaagacgcccgtaccttgctggccaacggctgtatctgcgtggccgaaggcgccaacatgccgaccaccctggaagcggtggatatcttcctggaagccggcatcctctatgccccgggcaaagcatccaacgccggcggtgtggccgtgtctggcctggagatgtcgcagaatgccatgcgcctgctgtggactgccggcgaagtggacagcaagctgcacaacatcatgcaatcgatccaccatgcttgcgtgcattatggtgaagaggcggatggccgggtcaattacgtgaaaggtgcgaacatcgccggctttgtcaaagtggcggatgcgatgttggctcagggcgtggtttga

SEQ ID NO: 138 - protein, 522 aa, Unknown
  Gene ID gdh_2 sequence from unknown bacterial species from environmental sample
QCLDAQEWGPWWPHFCACRLRVWLFEGQYCGCFCIHLYKTHQINSEKRHIALFRCDCFLVHSRKTNKSKIFGEMSTMIESVDSFLARLQQRDPGQPEFHQAVEEVLRTLWPFLEANPHYLQSGILERMVEPERAVLFRVSWVDDQGKVQVNRGYRIQMSSAIGPYKGGLRFHPSVNLSVLKFLAFEQVFKNSLTSLPMGGGKGGSDFDPKGKSDAEVMRFCQAFMSELYRHIGADCDVPAGDIGVGAREIGFMFGQYKRLANQFTSVLTGKGMTYGGSLIRPEATGYGCVYFAEEMLKRQDKRIDGRRVAVSGSGNVAQYAARKVMDLGGKVISMSDSEGTLYAEAGLTDAQWEALMALKNVKRGRISELAEQFGLEFRKGQTPWSLACDIALPCATQNELGAEDARTLLANGCICVAEGANMPTTLEAVDIFLEAGILYAPGKASNAGGVAVSGLEMSQNAMRLLWTAGEVDSKLHNIMQSIHHACVHYGEEADGRVNYVKGANIAGFVKVADAMLAQGVV

SEQ ID NO: 139 - DNA, 1353 bp, Unknown
  Gene ID gdh_3 sequence from unknown bacterial species from environmental sample
atgagtggtgccgttcagaaggaattagacgagttcatgcacgggctaaggaagcgcaaccccggtgaggaggagtttcaccaggcggtgcaggaggtcgtggagtcgactctgccttacgtgctcgatcatccggagtaccgcaaagcgtccattctcgagcgcatgaccgagcccgatcgcgtgatcatctttcgcgtggcctggcaggacgacgagggccatgtgcgcgcccaccgcggctaccgcgtgcagttcaataacgccatcggtccctacaaggggggattgcggttccactcttccgtcagcctttccattttgaagttcttgggcttcgagcagacgttcaagaacagccttacgggcctgcccatgggaggcggcaagggcggatcgaatttcaaccccaagggaaaatccgacggcgaagtgatgcgcttttgccaggccttcatgaccgagctgtaccggcacatcggcaaggacaccgatgttccggccggcgacatcggcgtgggtagccgggaaatcagctacctcttcggccagtacaagcggattacgaacgaatttaccggcgtgctgacgggcaaggggctctccttcggaggcagcctcattcggactgaagcgacaggctacggctgcgtctatttcatggaagagatgttgaaggccaagggcgacgctctcgtcggcaagactgtgacggtgtcgggctcgggaaacgtcgcgcagttcacggcgaaaaaactgatcgagctgggcgccaaggtgctcacgctgagcgattccgacggcttcatccacgatcgaaacgggatcgatctggaaaagctcaactggattctcgatctgaagaacgtacgtcggggtcgtatcgccgattatacgcagaagtggggaggggagtatcacgaagggggccgtccctgggtcgttccctgcgatctggcctttccctgcgccacccaaaacgaggtcacgggctcggacgcccgcatcctcatcgccaacggctgcatcggggttgcggaaggcgccaacatgccttccgacctggacgccatccacgcctttctggaggcgagaattctctacgccccgagcaaagcgtccaacgcgggcggtgtcgccgtctccggcttggagatgacccaaaactcccagcggctatcctggtcgtcggaagaggtgaacgagcgcctccacgccatcatgaagagcatccacgcgagctgcgtgcgctacggcaccgaaagagacggctacgtgaactacgtcaaaggcgcgaacctcgcggggttcgtgaaggtcgccgatgcgatgctcgccttcggcgtgctgtga

SEQ ID NO: 140 - protein, 450 aa, Unknown
  Gene ID gdh_3 sequence from unknown bacterial species from environmental sample
MSGAVQKELDEFMHGLRKRNPGEEEFHQAVQEVVESTLPYVLDHPEYRKASILERMTEPDRVIIFRVAWQDDEGHVRAHRGYRVQFNNAIGPYKGGLRFHSSVSLSILKFLGFEQTFKNSLTGLPMGGGKGGSNFNPKGKSDGEVMRFCQAFMTELYRHIGKDTDVPAGDIGVGSREISYLFGQYKRITNEFTGVLTGKGLSFGGSLIRTEATGYGCVYFMEEMLKAKGDALVGKTVTVSGSGNVAQFTAKKLIELGAKVLTLSDSDGFIHDRNGIDLEKLNWILDLKNVRRGRIADYTQKWGGEYHEGGRPWVVPCDLAFPCATQNEVTGSDARILIANGCIGVAEGANMPSDLDAIHAFLEARILYAPSKASNAGGVAVSGLEMTQNSQRLSWSSEEVNERLHAIMKSIHASCVRYGTERDGYVNYVKGANLAGFVKVADAMLAFGVL

SEQ ID NO: 141 - DNA, 1383 bp, Unknown
  Gene ID gdh_4 sequence from unknown bacterial species from environmental sample
atggcgacgctcctcacgacctcggaagctctgacgcgtgacacagggaaagccgtcgatcgattcatggatggcctcgtcgcgcgcaacccgaatcagccggagttccatcaggccgttcgcgaggtgtgcgagagcgtcatgccactcgtcttggagcggccggagtacgaggaggccggaatcctcgagcgcctcacggaaccggatcgcattctcacgttccgtgtggcctggcaggatgacgagggtcgcgtccgtatcaatcgcgcgtatcgcgtgcagttcaacaacgccattggtccttacaaaggcggcctccgctttcatcccaccgtcgatctctcggtcctcaagttcctcggcttcgagcagatcttcaagaacagtctgaccggtcttcccatgggtggcgcgaagggtggttctgatttcgatcccaaagggaagtcggataacgaggtcatgcggttctgtcaggcgatgatgtcggagctgtgtcacgacatcggcgaagacgtcgatgtgccggccggcgacattggtgtgggcgctcgagagattgggtatctgtttggcgaatatcgtcgcctcatgcgtcgcgtcgctggtgtgctcacggggaagggcttgtcgtttggcggcagcttgattcggaccgaagccactggctatggctgcgtctatttcgtcgagaacatgttgaatcacattggtgattccctcgacggcaagacctgtgtcgtttccggatcaggcaacgtcgcgctctacacggtcgagaaggtgacggctctgggcgggaaggtcgtcacgctctcggactcggacggcttcatctacgatcgcgacggcatcgatgcggagaagctggagtgggtcaaggagctcaaagaggttcgtcgcggtcgcatcagcgagtacgcggagcacttcggcggccagttccacgccgatgagcggccgtggcatgtcgagtgtcaggcggcgtttccttctgccacgcagaacgagttggacaaagaggatgcggaagtgctggtcgcgaacggctgtctcgcggtcggcgaaggcgcgaacatgccgagcacgagcgacgcaacgcgcgtgttcctcgaggctggaacgctcttcgcgccgggcaaggccgcgaatgccggtggggtcgccgtctcaggtctcgagcagagtcagaatgcgcagcgcctgttctggacgcgtgacgaggtggatcttcgtcttcaaggcatcatgaagacgatccacgacaagtgcgttgagcagggtcgcgtcgcgaatggtcagatcaactacgtgcagggcgccaatcgcgcaggtttcctcaaggtcgccgacgcgatgctcgcgcaaggcgtattttga

SEQ ID NO: 142 - protein, 460 aa, Unknown
  Gene ID gdh_4 sequence from unknown bacterial species from environmental sample
MATLLTTSEALTRDTGKAVDRFMDGLVARNPNQPEFHQAVREVCESVMPLVLERPEYEEAGILERLTEPDRILTFRVAWQDDEGRVRINRAYRVQFNNAIGPYKGGLRFHPTVDLSVLKFLGFEQIFKNSLTGLPMGGAKGGSDFDPKGKSDNEVMRFCQAMMSELCHDIGEDVDVPAGDIGVGAREIGYLFGEYRRLMRRVAGVLTGKGLSFGGSLIRTEATGYGCVYFVENMLNHIGDSLDGKTCVVSGSGNVALYTVEKVTALGGKVVTLSDSDGFIYDRDGIDAEKLEWVKELKEVRRGRISEYAEHFGGQFHADERPWHVECQAAFPSATQNELDKEDAEVLVANGCLAVGEGANMPSTSDATRVFLEAGTLFAPGKAANAGGVAVSGLEQSQNAQRLFWTRDEVDLRLQGIMKTIHDKCVEQGRVANGQINYVQGANRAGFLKVADAMLAQGVF

SEQ ID NO: 143 - DNA, 1386 bp, Unknown
  Gene ID gdh_5 sequence from unknown bacterial species from environmental sample
atgtccaacaagattcgcgcgttgaacccgacgctgagtacacctatggctttggtccaggaagtcctcggggtcgtcagcaggcgcaacccgagcgaaccggagtttcttcaggcggtcaccgaagtgcttgaatcgatcgcgccggtcgtccagcgtcgcaaggattaccgcgatgcaaagattctcgaacgcatcgttgagccggagcgtatgatccagttccgtgttccgtggatcgacgataagggccaaatccaggttaatcgcggtttccgtgtgcagatgaatagcgcgctcggcccttacaaaggcgggttacggtttcatccgaccgtaaatgccagcatcctcaagttccttgctttcgaacaggtatttaaaaactcgctcaccactttgccgatgggcggaggcaaaggcggcgccgatttcgacccgaaaggaaaatccgataccgaagtgatgcacttctgccaatcgttcatgaccgagttgtttcgacacgtcggtcccgatacggacgtgccggccggcgatatcggagttggcggccgggaaatcggttatctgtttggtcaatacaaacgtctggccaatgagttcactggcgttctcaccggcaaatcgctcagttggggcgggtcgctcatccgcccgcaagcgaccggttatggcgccgtttactttgccgaagagatgctcaagacgcgaaagcaaggtctcgaaggcagggtttgtaccgtctccggttcgggcaacgccgcgcaatacacagtttcaaaattgaaccaggtgggcgccaaagtcgtgaccatgtccgattcaggcgggttcatttatgacaaggatggcatcaccgacgaaaagctgagctggatcatggatttgaagaacgtgcggcgtcgccgcatcaaggagtacgccgatcagtttcaaggaacaacttatacggaaggccagcggccctggagcgtaccgtgtgaatgcgcgtttccgtgtgccacgcaaaatgaaatcagtggtgaagatgcgaaagcgttgatcgacaacggctgctttctggtttcggaagccgcaaatatgccgaccgcgccagcgggagtggatctcttcctcgctaataaggtcctttatggtcccggcaaagccgccaatgccggcggggtggcggtttccggcttggagatggcgcaaaattcaatgcgtctgccgtggccgcgcgctgaagtggatcaacggcttcgccaaatcatggccacgatccacagaaacgcgtgggagaccgcggccgagtacgatcaacccggcaatcttgtcatcggcgcgaatatcgccggtttcgttaaagtcgccgacgccatgctcgaccagggtgtggtctaa

SEQ ID NO: 144 - protein, 461 aa, Unknown
  Gene ID gdh_5 sequence from unknown bacterial species from environmental sample
MSNKIRALNPTLSTPMALVQEVLGVVSRRNPSEPEFLQAVTEVLESIAPVVQRRKDYRDAKILERIVEPERMIQFRVPWIDDKGQIQVNRGFRVQMNSALGPYKGGLRFHPTVNASILKFLAFEQVFKNSLTTLPMGGGKGGADFDPKGKSDTEVMHFCQSFMTELFRHVGPDTDVPAGDIGVGGREIGYLFGQYKRLANEFTGVLTGKSLSWGGSLIRPQATGYGAVYFAEEMLKTRKQGLEGRVCTVSGSGNAAQYTVSKLNQVGAKVVTMSDSGGFIYDKDGITDEKLSWIMDLKNVRRRRIKEYADQFQGTTYTEGQRPWSVPCECAFPCATQNEISGEDAKALIDNGCFLVSEAANMPTAPAGVDLFLANKVLYGPGKAANAGGVAVSGLEMAQNSMRLPWPRAEVDQRLRQIMATIHRNAWETAAEYDQPGNLVIGANIAGFVKVADAMLDQGVV

SEQ ID NO: 145 - DNA, 1392 bp, Unknown
  Gene ID gdh_6 sequence from unknown bacterial species from environmental sample
atgctcgtcagccggtccacgcgcgcccctctctccacctacgtcaccgacatcctcgccctcgtcaaagccaagaatcccgcggaaccggagttccaccaggcggtcgaagaggttctcgaaagcctcgacctggtcgtgcagcggcggccggatctcgcgaaagcaaagattctcgagcggatcgtcgagcccgaacgcgtgatcatgttccgcgtcccgtggcaggacgatcgcggcgaggttcatatcaatcgcggatatcgggtccagatgaacggcgcgcttggtccctataagggcggtctgcgcttccatcattcggtgacgctcggggtgctgaagttcctcgcgttcgagcaggtgttcaagaactcactcacgacgctgtcgatgggcggcggcaagggtggttccgacttccatccgcacggccgttctgacgatgaagtgatgcgtttctgtcagagctttatgacggagctgatgcgtcacatcggccctgacaccgacgtgcccgcgggtgacatcggcgtcggcggccgcgagatcgggtacctgttcggccagtatcgccgtctgcgcaatgaattcacgggcgtgctcactggcaaaggtttgaactggggtggctcgctgatccgccccgaggcgaccggttacggcgctgtctacttcaccgccgagatgctggccacccgcaacgaaacgctggaagggaaggtctgtctcgtctcgggcagcggcaacgtcgcccagtacacgatcgagaagctgctcgatctcggagccagagcggtaacggtctccgactccgacggctacatctacgacgaagccggcttcgaccgcgagaagctcgcgtatctgatggagctgaagaacgtccgccgcggccgcgtgcgcgaatacgccgatcggttcaagggcgccgtgtaccaggagataaaggccgccaacgacttcaacccgctctggatgcaccgtgcgcactgcgcgttcccaagcgcgacgcagaacgagatcaatgagaaggatgccggacatctggtcgcgagcggcgtgctcgccgtcgccgagggcgccaacatgccgtgcaccattgcagcgacaaaggtgttgatcgacggcggcgtactctacgctcccggcaaggccgccaatgcgggcggcgtcgcgacgtcaggcttggagatggcgcagaacagcgcgcggatcgcctggtcgcgcgagcgcgtcgacaccgagctgcaccggatcatgaaagcgatccacgccgcgtgccgcgaaaccgccgacgaatacggcgtccccggcaactacgtccacggcgccaatatcgcggggttcaccaaggtcgcggacgcgatgctcgaccagggactgatttga

SEQ ID NO: 146 - protein, 463 aa, Unknown
  Gene ID gdh_6 sequence from unknown bacterial species from environmental sample
MLVSRSTRAPLSTYVTDILALVKAKNPAEPEFHQAVEEVLESLDLVVQRRPDLAKAKILERIVEPERVIMFRVPWQDDRGEVHINRGYRVQMNGALGPYKGGLRFHHSVTLGVLKFLAFEQVFKNSLTTLSMGGGKGGSDFHPHGRSDDEVMRFCQSFMTELMRHIGPDTDVPAGDIGVGGREIGYLFGQYRRLRNEFTGVLTGKGLNWGGSLIRPEATGYGAVYFTAEMLATRNETLEGKVCLVSGSGNVAQYTIEKLLDLGARAVTVSDSDGYIYDEAGFDREKLAYLMELKNVRRGRVREYADRFKGAVYQEIKAANDFNPLWMHRAHCAFPSATQNEINEKDAGHLVASGVLAVAEGANMPCTIAATKVLIDGGVLYAPGKAANAGGVATSGLEMAQNSARIAWSRERVDTELHRIMKAIHAACRETADEYGVPGNYVHGANIAGFTKVADAMLDQGLI

SEQ ID NO: 147 - DNA, 1470 bp, Unknown
  Gene ID gdh_7 sequence from unknown bacterial species from environmental sample
atggagggcgagaacatcatcgacgccgagccgcaaagccgcctaacattcgcgccgcgcagggcacggagtcagcacgggggcgcaggaggcaagccggagaatgctatgagtcaatacgtgtctgatctgatggcggaggtaaaagcgaagaaccccgccgagcctgagttccaccaggcggtcttcgaggtcgcggagtcgcttaccagtgtgcttgaagcgcatccgcagttccgcgaagcgaagatcctcgagcggatgatcgagcccgagcgcgtgatcatgttccgcgtgccatggcgcgacgataacggcacgttgcacgtgaaccgcggcttccgcgtgcagatgaacagcgcgatcggcccgtacaaaggcggcctgcgctttcatcccacggtcaacctcggcatcctgaaattcctcgccttcgagcaggtcttcaaaaatgccctaacgacactgccgatgggcggcggaaagggcggtgcggacttcgatccgaagggcaagagcgacatggaagtaatgcgcttttgccaggcgttcatgtccgagctggcgcggcatatcgggccggacaccgacgtgccggcgggcgacatcggcgtcggcgcgcgggagatcggtttcctcttcggcatgtacaagaagctgaagaacgagttcaccggcgtgatgactgggaaaggcctcacgtggggtggctccgtcatccgcccggaggcaacgggctatggcgcggtctacttcgcggccgaaatgctcaagacgcgcaaagaggaactgcgcggcaagacctgcctcgtctccgggagcgggaacgttgcgcaatacacggtggagaagttgatctcgttaggcgcaaagccggtcacgctgtcggattcggctggctacatctacgacgagagcggcatcacgcgcgagaagctcgcgttcgttatggagctcaagaacgtgcgccgcggccgcatctcagaatacgcggagaagttcactggcgccgtctacacgccgctcgacggcacgtccgagcacaacccgctctgggaccacaaggcggagtgcgccttccccagcgcgacccagaacgagatcagtgagcgcgacgcggcgaacctgctgcgcaacggcgtctacgttgtctccgaaggcgcgaacatgccgagcacgatcggcgcgataaaccagttcctggctgcccagattctcttcggccccgggaaagcagccaacgcgggcggcgtcgcgacctctgggctcgagatggcgcagaacagcatgcgcatttcgtggacgcgcgaagaggtggataatcgcctctacaacatcatgaaaacgatccacgaagtctgccaccgcacggccgacaagtacggcacgcccggcaactacgtgaatggcgccaacatcgccggcttcctcaaggtggcgaacgcgatgatggaccagggcctggtctga

SEQ ID NO: 148 - protein, 489 aa, Unknown
  Gene ID gdh_7 sequence from unknown bacterial species from environmental sample
MEGENIIDAEPQSRLTFAPRRARSQHGGAGGKPENAMSQYVSDLMAEVKAKNPAEPEFHQAVFEVAESLTSVLEAHPQFREAKILERMIEPERVIMFRVPWRDDNGTLHVNRGFRVQMNSAIGPYKGGLRFHPTVNLGILKFLAFEQVFKNALTTLPMGGGKGGADFDPKGKSDMEVMRFCQAFMSELARHIGPDTDVPAGDIGVGAREIGFLFGMYKKLKNEFTGVMTGKGLTWGGSVIRPEATGYGAVYFAAEMLKTRKEELRGKTCLVSGSGNVAQYTVEKLISLGAKPVTLSDSAGYIYDESGITREKLAFVMELKNVRRGRISEYAEKFTGAVYTPLDGTSEHNPLWDHKAECAFPSATQNEISERDAANLLRNGVYVVSEGANMPSTIGAINQFLAAQILFGPGKAANAGGVATSGLEMAQNSMRISWTREEVDNRLYNIMKTIHEVCHRTADKYGTPGNYVNGANIAGFLKVANAMMDQGLV

SEQ ID NO: 149 - DNA, 1347 bp, Unknown
  Gene ID gdh_8 sequence from unknown bacterial species from environmental sample
atgaacgtcaggcaatacatcgggagcttcatggagcagctggtggcccggaaccctgcccagcccgaattccaccaggctgtgaaagaggtggtcgagtctctggagccgtgcctcgggcgtcacccggaatacgtcgagcaccgcatcctcgagcgcatgagcgagcctgaccgcgtcatcatgttcagggtcgcttggcaagacgatcggggccaggcccaggtgaaccgggcgttccgggtcgagttcaacaacgccatcggcccctacaaggggggcctgcggttccacccgaccgtgaacctcggcatcctcaagtttctcggattcgagcagatcctgaagaacagcctcactacgctgcccatgggtggcggcaagggcggcagcgatttcgatcccaaggggaagtccgacggcgaggtgatgcgcttctgccagagcttcatgaacgagctgcaccactacatcggccagaacatcgacgtcccggcgggcgatatcggcgtcggggggcgcgagatcgggttcctgttcggtcagttcaagcggctcacccactcgttcgagggcgtgctcacgggcaagggcctgggctggggcggctcgctcgtccgtccggaagccaccggctacggctgcgtgtatttcgcggaggagcagctcaaggctcgcggagagagcttcgccggcaagacggtggccgtctcgggctccgggaacgtggcccaatacgccatcgagaaggtgaacgagctcggcggcaaagtcgtgacgctctccgattccgacgggaccatccacgatcccgacggcatccgcgacgaaaagtgggcgttcctcatggatctcaagaacgtgcgccgcgggcggatccgtgagtacgcgcagcgcttcaaggccaattacaaggagggggtgcggccgtggggcatcaagtgcgacatcgccctgccgtgcgcgacccagaacgagatcagcggcgatgaagcgcgcacgctggtgaaaaatggctgcgtttgcgtcgcagagggcgcgaacatgccgaccaccctcgagggcgtggaggtgttcctcgccgccaagatcctctacggtccgggcaaggccgccaacgccggcggtgtcgcgacgtccgggctcgagatgtcgcagaacagcctccggctgtcgtggagccgggaagaggtcgaccagcggctgcgcgggatcatgaaggagatccacaagtcgtgcgtcgacaccgcccgggagtacgaccagccgggcaactacgtgctgggcgccaacatagcgggcttcacgaaggtggcgaacgccatgatggaccaggggctggtctag

SEQ ID NO: 150 - protein, 448 aa, Unknown
  Gene ID gdh_8 sequence from unknown bacterial species from environmental sample
MNVRQYIGSFMEQLVARNPAQPEFHQAVKEVVESLEPCLGRHPEYVEHRILERMSEPDRVIMFRVAWQDDRGQAQVNRAFRVEFNNAIGPYKGGLRFHPTVNLGILKFLGFEQILKNSLTTLPMGGGKGGSDFDPKGKSDGEVMRFCQSFMNELHHYIGQNIDVPAGDIGVGGREIGFLFGQFKRLTHSFEGVLTGKGLGWGGSLVRPEATGYGCVYFAEEQLKARGESFAGKTVAVSGSGNVAQYAIEKVNELGGKVVTLSDSDGTIHDPDGIRDEKWAFLMDLKNVRRGRIREYAQRFKANYKEGVRPWGIKCDIALPCATQNEISGDEARTLVKNGCVCVAEGANMPTTLEGVEVFLAAKILYGPGKAANAGGVATSGLEMSQNSLRLSWSREEVDQRLRGIMKEIHKSCVDTAREYDQPGNYVLGANIAGFTKVANAMMDQGLV

SEQ ID NO: 151 - DNA, 1374 bp, Unknown
  Gene ID gdh_9 sequence from unknown bacterial species from environmental sample
atggcaaccgccaagacatcgtccgccgtgcaaaagcaggtggacgcgttcatgcagcatgtgaaggtccgcaacggcaacgagcctgaattcctccaggccgtgcacgaagtggccgagaccgtgatccctttcatggaggccaaccccaagtacaagggcaagatgctcctggagcgcatggtggagcctgagcgcaccatcctcttccgcgtgccctgggtagacgatcgcggcaacatccaagtgaaccgcggctaccgcgtggagttcaacagcgctatcggtccttacaagggcggcctgcgcttccaccccacggtgaccctcagcgtgttgaagttcctgggcttcgagcaagtgttcaagaacagcctcaccaccctgcccatgggcggcggcaagggcggtagcgatttcgacccgaaaggcaagagcgataatgaagtgatgcgcttctgccagagcttcatgaccgagctgtggcgccacatcggtgccgacacggacgtgcccgccggcgacatcggcgtgggcggccgcgagatcggtttcatgttcggccaggacaagcgcctgcgcaacgagttcacgggcgtgttcacgggcaagggccgcacgtggggcggttcgctgatccgtccggaggccaccggctacggctgcgtgtacttcgcggaggagatgatgaagcgcaacaaggagagcttcaagggcaagacggtggcggtgagcggcagcggcaacgtggcccagtacgccatcgagaaggccacgcagctcggtgcgaaagtggtgacctgttccgacagcgacggcagcatcttcgatcccgcgggcatcagcggcgacaagctcgcgttcatcatggaactgaagaacgtgaagcgtggccgcatcgaggaatacgcgaagaagttcaagggcagcacctacaagaagggcgcccgtgtgtgggacgtggtatccaagtgcgacatcgccctgccctgcgccacgcagaacgagctggacggaaagaacgcgaaggacctgatcaagaaaggcgtgcagtacgtggccgaaggcgccaacatgcccaccaccccggagggcatcgaagccttccacgcggcgaaggtgtacttcgcgccgggcaaggccagcaacgccggtggtgtggccaccagcggcctggagatgagccagaacagccagcgcctcagctggacgcgtgacgaggtggaccaccagctccacaagatcatgaagaacatccatgccgcctgtgtgcagtatggcaccgaaggcaagcacgtgaactacgtgaagggcgccaacatcgccggcttcgtgaaagtggccgacgcgatgctggaccaaggcgtggtgtag

SEQ ID NO: 152 - protein, 457 aa, Unknown
  Gene ID gdh_9 sequence from unknown bacterial species from environmental sample
MATAKTSSAVQKQVDAFMQHVKVRNGNEPEFLQAVHEVAETVIPFMEANPKYKGKMLLERMVEPERTILFRVPWVDDRGNIQVNRGYRVEFNSAIGPYKGGLRFHPTVTLSVLKFLGFEQVFKNSLTTLPMGGGKGGSDFDPKGKSDNEVMRFCQSFMTELWRHIGADTDVPAGDIGVGGREIGFMFGQDKRLRNEFTGVFTGKGRTWGGSLIRPEATGYGCVYFAEEMMKRNKESFKGKTVAVSGSGNVAQYAIEKATQLGAKVVTCSDSDGSIFDPAGISGDKLAFIMELKNVKRGRIEEYAKKFKGSTYKKGARVWDVVSKCDIALPCATQNELDGKNAKDLIKKGVQYVAEGANMPTTPEGIEAFHAAKVYFAPGKASNAGGVATSGLEMSQNSQRLSWTRDEVDHQLHKIMKNIHAACVQYGTEGKHVNYVKGANIAGFVKVADAMLDQGVV

SEQ ID NO: 153 - DNA, 1329 bp, Unknown
  Gene ID gdh_10 sequence from unknown bacterial species from environmental sample
tctctggagtcattcctcaaccatgtccaaaagcgcgacccgaatcaaaccgagttcgcgcaagccgttcgtgaagtaatgaccacactctggccttttcttgaacaaaatccaaaatatcgccagatgtcattactggagcgtctggttgaaccggagcgcgtgatccagtttcgcgtggtatgggttgatgatcgcaaccagatacaggtcaaccgtgcatggcgtgtgcagttcagctctgccatcggcccgtacaaaggcggtatgcgcttccatccgtcagttaacctttccattctcaaattcctcggctttgaacaaaccttcaaaaatgccctgactactctgccgatgggcggtggtaaaggcggcagcgatttcgatcagaaaggaaaaagcgaaggtgaagtgatgcgtttttgccaggcgctgatgactgaactgtatcgccacctgggcgcggataccgacgttccggcaggtgatatcggggttggtggtcgtgaagtcggctttatggcggggatgatgaaaaagctctccaacaataccgcctgcgtcttcaccggtaagggcctttcatttggcggcagtcttattcgcccggaagctaccggctacggtctggtttatttcacagaagcaatgctaaaacgccacggtatgggttttgaagggatgcgcgtttccgtttctggctccggcaacgtcgcccagtacgctatcgaaaaagcgatggaatttggtgctcgtgtgatcactgcgtcagactccagcggcactgtagttgatgaaagcggattcacgaaagagaaactggcacgtcttatcgaaatcaaagccagccgcgatggtcgagtggcagattacgccaaagaatttggtctggtctatctcgaaggccaacagccgtggtctctaccggttgatatcgccctgccttgcgccacccagaatgaactggatgttgacgccgcgcatcagcttatcgctaatggcgttaaagccgtcgccgaaggggcaaatatgccgaccaccatcgaagcgactgaactgttccagcaggcaggcgtactatttgcaccgggtaaagcggctaatgctggtggcgtcgctacatcgggcctggaaatggcacaaaacgctgcgcgcctgggctggaaagccgagaaagttgacgcacgtttgcatcacatcatgctggatatccaccatgcctgtgttgagcatggtggtgaaggtgagcaaaccaactacgtgcagggcgcgaacattgccggttttgtgaaggttgccgatgcgatgctggcgcagggtgtgatttaa

SEQ ID NO: 154 - protein, 442 aa, Unknown
  Gene ID gdh_10 sequence from unknown bacterial species from environmental sample
SLESFLNHVQKRDPNQTEFAQAVREVMTTLWPFLEQNPKYRQMSLLERLVEPERVIQFRVVWVDDRNQIQVNRAWRVQFSSAIGPYKGGMRFHPSVNLSILKFLGFEQTFKNALTTLPMGGGKGGSDFDQKGKSEGEVMRFCQALMTELYRHLGADTDVPAGDIGVGGREVGFMAGMMKKLSNNTACVFTGKGLSFGGSLIRPEATGYGLVYFTEAMLKRHGMGFEGMRVSVSGSGNVAQYAIEKAMEFGARVITASDSSGTVVDESGFTKEKLARLIEIKASRDGRVADYAKEFGLVYLEGQQPWSLPVDIALPCATQNELDVDAAHQLIANGVKAVAEGANMPTTIEATELFQQAGVLFAPGKAANAGGVATSGLEMAQNAARLGWKAEKVDARLHHIMLDIHHACVEHGGEGEQTNYVQGANIAGFVKVADAMLAQGVI

SEQ ID NO: 155 - DNA, 1341 bp, Unknown
  Gene ID gdh_11 sequence from unknown bacterial species from environmental sample
atgatcgaatccgtcgacaatttccttgcacgcctgcaacagcgtgaccctggccaacccgagtttcaccaggccgtcgaagaagtgctgcgcaccttgtggccctttctggaagccaaccctcactacctgcaagcgggcattctcgagcgcatggtcgagcctgagcgtgcagtgttgttccgggtgtcgtgggtggacgatcacggcaaggttcaggtcaaccgcggttaccgtatccagatgaacagcgccattggcccctacaagggcggcctgcgcttccacccttcggtgaacctcagtgttctgaaattcctcgcattcgagcaagtcttcaagaactccctgacctcgctgcccatgggcggtggcaagggtgggtctgacttcgatcccaagggcaagagcgacgccgaagtgatgcgcttctgccaggccttcatgagcgagctgtaccgtcacatcggtgccgactgcgatgttccggccggggacatcggagtaggggcgcgcgagatcggctatatgttcgggcaatacaagcgtctggccaaccagttcacctccgtgctgaccggcaagggcatgacctatggcggcagcctgattcgtccggaagccacgggctatggctgtgtgtattttgccgaggagatgctcaagcgccagggccagcgcatcgacggccgtcgcgtggcgatctcgggctcgggcaacgtcgcgcaatacgccgcgcgcaaggtgatggacctggggggcaaggtgatctcgctgtctgattccgaaggtaccttgtacgccgaagcgggcctcaccgacgcgcagtgggaagcggtgatgaccctcaagaacgtcaagcgcggccgcatcagcgagctggccgggcaattcggcctggagttccgcaagggccagacgccgtggagcctggcctgcgacatcgcgttgccatgcgcgacgcagaacgaactggacgtcgaggatgccaaggcactgttggccaacggctgtatctgcgtcgcagaaggcgccaacatgcccacgaccctggcggctgtggacatcttccttgaagctggcatcctctatgcgccgggcaaggcgtccaatgcgggtggcgttgcggtgtcgggcctggaaatgtcgcagaacgccatgcgcttgctgtggactgctggcgaagtggacagcaagctgcatggcatcatgcagtcgattcaccacgcctgcgttcactatggtgaagagggcgatggccgggtcaactatgtcaaaggggccaacattgcgggcttcgtgaaggtggccgatgcgatgctggcccaaggggtcgtctga

SEQ ID NO: 156 - protein, 446 aa, Unknown
  Gene ID gdh_11 sequence from unknown bacterial species from environmental sample
MIESVDNFLARLQQRDPGQPEFHQAVEEVLRTLWPFLEANPHYLQAGILERMVEPERAVLFRVSWVDDHGKVQVNRGYRIQMNSAIGPYKGGLRFHPSVNLSVLKFLAFEQVFKNSLTSLPMGGGKGGSDFDPKGKSDAEVMRFCQAFMSELYRHIGADCDVPAGDIGVGAREIGYMFGQYKRLANQFTSVLTGKGMTYGGSLIRPEATGYGCVYFAEEMLKRQGQRIDGRRVAISGSGNVAQYAARKVMDLGGKVISLSDSEGTLYAEAGLTDAQWEAVMTLKNVKRGRISELAGQFGLEFRKGQTPWSLACDIALPCATQNELDVEDAKALLANGCICVAEGANMPTTLAAVDIFLEAGILYAPGKASNAGGVAVSGLEMSQNAMRLLWTAGEVDSKLHGIMQSIHHACVHYGEEGDGRVNYVKGANIAGFVKVADAMLAQGVV

SEQ ID NO: 157 - DNA, 1374 bp, Unknown; identical to SEQ ID NO: 151
  Gene ID gdh_12 sequence from unknown bacterial species from environmental sample

SEQ ID NO: 158 - protein, 457 aa, Unknown; identical to SEQ ID NO: 152
  Gene ID gdh_12 sequence from unknown bacterial species from environmental sample

SEQ ID NO: 159 - DNA, 1383 bp, Unknown
  Gene ID gdh_13 sequence from unknown bacterial species from environmental sample
atggcgacgctcctcacgacctcggaagctctgacgcgtgacacagggaaagccgtcgatcgattcatggatggcctcgtcgcgcgcaacccgaatcagccggagttccatcaggccgttcgcgaggtgtgcgagagcgtcatgccactcgtcttggagcggccggagtacgaggaggccggaatcctcgagcgcctcacggaaccggatcgcattctcacgttccgtgtggcctggcaggatgacgagggtcgcgtccgtatcaatcgcgcgtatcgcgtgcagttcaacaacgccattggtccttacaaaggcggcctccgctttcatcccaccgtcgatctctcggtcctcaagttcctcggcttcgagcagatcttcaagaacagtctgaccggtcttcccatgggtggcgcgaagggtggttctgatttcgatcccaaagggaagtcggataacgaggtcatgcggttctgtcaggcgatgatgtcggagctgtgtcacgacatcggcgaagacgtcgatgtgccggccggcgacattggtgtgggcgctcgagagattgggtatctgtttggcgaatatcgtcgcctcatgcgtcgcgtcgctggtgtgctcacggggaagggcttgtcgtttggcggcagcttgattcggaccgaagccactggctatggctgcgtctatttcgtcgagaacatgttgaatcacattggtgattccctcgacggcaagacctgtgtcgtttccggatcaggcaacgtcgcgctctacacggtcgagaaggtgacggctctcggcgggaaggtcgtcacgctctcggactcggacggcttcatctacgatcgcgacggcatcgatgcggagaagctggagtgggtcaaggagctcaaagaggttcgtcgcggtcgcatcagcgagtacgcggagcacttcggcgcccagttccacgccgatgagcggccgtggcatgtcgagtgtcaggcggcgtttccttctgccacgcagaacgagttggacaaagaggatgcggaagtgctggtcgcgaacggctgtctcgcggtcggcgaaggcgcgaacatgccgagcacgagcgacgcaacgcgcgtgttcctcgaggctggaacgctcttcgcgccgggcaaggccgcgaatgccggtggggtcgccgtctcaggtctcgagcagagtcagaatgcgcagcgcctgttctggacgcgtgacgaggtggatcttcgtcttcaaggcatcatgaagacgatccacgacaagtgcgttgagcagggtcgcgtcgcgaatggtcagatcaactacgtgcagggcgccaatcgcgcaggtttcctcaaggtcgccgacgcgatgctcgcgcaaggcgtattttga

SEQ ID NO: 160 - protein, 460 aa, Unknown
  Gene ID gdh_13 sequence from unknown bacterial species from environmental sample
MATLLTTSEALTRDTGKAVDRFMDGLVARNPNQPEFHQAVREVCESVMPLVLERPEYEEAGILERLTEPDRILTFRVAWQDDEGRVRINRAYRVQFNNAIGPYKGGLRFHPTVDLSVLKFLGFEQIFKNSLTGLPMGGAKGGSDFDPKGKSDNEVMRFCQAMMSELCHDIGEDVDVPAGDIGVGAREIGYLFGEYRRLMRRVAGVLTGKGLSFGGSLIRTEATGYGCVYFVENMLNHIGDSLDGKTCVVSGSGNVALYTVEKVTALGGKVVTLSDSDGFIYDRDGIDAEKLEWVKELKEVRRGRISEYAEHFGAQFHADERPWHVECQAAFPSATQNELDKEDAEVLVANGCLAVGEGANMPSTSDATRVFLEAGTLFAPGKAANAGGVAVSGLEQSQNAQRLFWTRDEVDLRLQGIMKTIHDKCVEQGRVANGQINYVQGANRAGFLKVADAMLAQGVF

SEQ ID NO: 161 - DNA, 1347 bp, Unknown
  Gene ID gdh_14 sequence from unknown bacterial species from environmental sample
atgaacgcgaaaacgtatctggcgagcttcatggagcagctcgtcactcgcaatccggcagagcaggagtttcaccaggccgtacgcgaggtcgtcgaatctctcgagccgtgtttggagcggcaccctgaatacatcgatcattcgatcctcgagcgcatggccgagcccgatcgcgtcatcagtttccgcgtcgcgtggcaggacgatcgcggccgcccccatgtcaatcgcggcttccgtgtggagttcaacaatgcaatcgggccctacaaggggggcctccgatttcaccccaccgtcaatctcagcatcctcaagttcctcggtttcgaacagatcttgaagaacagcttgaccacgctgccgatgggcggcgccaaaggggggagcaacttcgatcccaagggcaaatccgacagcgaggtgatgcgattttgccagagcttcatgaacgagctctatcggcatatcggctccgacatcgacgtgccggccggtgacatcggcgtcggcggacgcgagatagggtttctcttcggtcaatacaagaagctgacccactccttcgaaggcgtgctcaccggcaaagggctcggctggggcgggtcgctcattcgccccgaggccaccggttacggctgcgtgtatttcgccgaagagatgctgaaaacgcgcggccagagcttcaagggcaaaacggtgacggtgtcgggctccggcaacgtcgcccaatattcggtggagaaggtcaatcagctaggcggcagggtggtgtcgctgtccgactcggaagggaccatttacgatccggatggcatccgcgacgacaagtgggaattcttgctgacgctaaaaaacgtgcggcgcgggcgtctgcgcgaatatgccgagcgcttcaaggccgagttccgcgatggcgtgtgcccgtggagcatcaaatgcgatgtcgccctcccgagcgccacgcaaaacgaaatctccgccgaggacgccaaggcactcgtcaaaaatggctgcatctgcgtggcggaaggggcgaacatgcccactaccgccgaaggggtggagatcttccagaaaggtaaagtcctcttcgggccgggcaaagccgccaacgccgggggcgtcgctacctcgggactcgagatgtcgcaaaacagcctgcgcctctcttggacgcgcgaagaggtcgatcggcgtctttacgacatcatgaaggccattcaccacgcctgcgtcacgacggcccacgagtacgatcgccccggcgactacgtgctcggcgccaacatcgcaggcttcgtcaaggtggccaacgcgatgatcgatcaaggcctggtctga

SEQ ID NO: 162 - protein, 448 aa, Unknown
  Gene ID gdh_14 sequence from unknown bacterial species from environmental sample
MNAKTYLASFMEQLVTRNPAEQEFHQAVREVVESLEPCLERHPEYIDHSILERMAEPDRVISFRVAWQDDRGRPHVNRGFRVEFNNAIGPYKGGLRFHPTVNLSILKFLGFEQILKNSLTTLPMGGAKGGSNFDPKGKSDSEVMRFCQSFMNELYRHIGSDIDVPAGDIGVGGREIGFLFGQYKKLTHSFEGVLTGKGLGWGGSLIRPEATGYGCVYFAEEMLKTRGQSFKGKTVTVSGSGNVAQYSVEKVNQLGGRVVSLSDSEGTIYDPDGIRDDKWEFLLTLKNVRRGRLREYAERFKAEFRDGVCPWSIKCDVALPSATQNEISAEDAKALVKNGCICVAEGANMPTTAEGVEIFQKGKVLFGPGKAANAGGVATSGLEMSQNSLRLSWTREEVDRRLYDIMKAIHHACVTTAHEYDRPGDYVLGANIAGFVKVANAMIDQGLV

SEQ ID NO: 163 - DNA, 1338 bp, Unknown
  Gene ID gdh_15 sequence from unknown bacterial species from environmental sample
atgaattcagtccaggaagtcctcgacatcgttcatcgaagaaatccacatcagcctgaattccttcaggcggtgacggaagtcttcgagtcgatcagtccagtgatcgaacggcgcaaagattatcgcgacgccaacattctcgagcgcatcgtcgagccggaacggatgattcagttccgtgttccgtggattgacgatgcgggcaaggtgcgggtgaatcgcggctatcgcgtgcaaatgaacagcgcgctcggtccgtacaagggcgggctgcgttttcatcccacagttaatgccagcattctgaaattcctcgcatttgaacaggtgttcaaaaattcgctcacgactctgccgatgggcggcggcaaaggcggcgccgatttcgatccgaagaacaagtcggacaacgaagtgatgcatttttgccaatctttcatgaccgaattgttccgccatgtcggccccgacacagacgtgccggcgggcgacattggagttgggggtcgtgagattggttacttgttcggccaatacaaacggctggctaatgaatttaccggcgtgctgaccggcaaatcattgaactggggcggctcgctcatccggccgcaagctaccggttatggcgcggtttatttcgcggaagagatgctgaagacgcgcagcgaaggtttggaaggaagagtgtgcactgtctccggctcgggtaacgccgcgcaatacacggtttcgaagttaaaccaggtcggcgccaaggttgtcacgatgtctgattccagtggtttcatttatgacaaggatgggatcaccgaggaaaaactaagctgggtgatggaactgaaaaacgaacggcgcggtcgcatcaaagaatacgccaattttttcaaagcgacgtatgtcgacggcaaaccgccatggagtgttccatgcgaatgcgccttcccgtgcgcaacgcagaacgaaattagcggcgaagacgcgaagattctgctcgcaaacggttgctttctcgtttccgaagcggccaacatgccgaccgcgcccgcaggagttgacctttttctggcgaacaaaatcctttacggtcccggcaaggccgcgaatgctggtggcgtggccgtttcgggattggagatggcgcaaaattcgatgcgcttaccctggccgcgcgcggaagtcgatcaacgccttcgccagattatggccaccattcataagaacgcatggaacacagcggcggaatacgaccagccgggtaaccttgttatcggcgccaacatcgccgggttcgttaaggtagctgacgcgatgctcgatcagggcgtggtctag

SEQ ID NO: 164 - protein, 445 aa, Unknown
  Gene ID gdh_15 sequence from unknown bacterial species from environmental sample
MNSVQEVLDIVHRRNPHQPEFLQAVTEVFESISPVIERRKDYRDANILERIVEPERMIQFRVPWIDDAGKVRVNRGYRVQMNSALGPYKGGLRFHPTVNASILKFLAFEQVFKNSLTTLPMGGGKGGADFDPKNKSDNEVMHFCQSFMTELFRHVGPDTDVPAGDIGVGGREIGYLFGQYKRLANEFTGVLTGKSLNWGGSLIRPQATGYGAVYFAEEMLKTRSEGLEGRVCTVSGSGNAAQYTVSKLNQVGAKVVTMSDSSGFIYDKDGITEEKLSWVMELKNERRGRIKEYANFFKATYVDGKPPWSVPCECAFPCATQNEISGEDAKILLANGCFLVSEAANMPTAPAGVDLFLANKILYGPGKAANAGGVAVSGLEMAQNSMRLPWPRAEVDQRLRQIMATIHKNAWNTAAEYDQPGNLVIGANIAGFVKVADAMLDQGVV

SEQ ID NO: 165 - DNA, 1422 bp, Unknown
  Gene ID gdh_16 sequence from unknown bacterial species from environmental sample
atgtcgtcgcaagtagcctcaccgacccgaaagctggttcgtcctcccgtctcacccgcgacccgtgactacattgccgcgctgctcgcggaggtgaaggcgaagaatccggcggagccggagttccaccaggcggtgcacgaagtcgccgagtcggtgggactcgtgctcgagcgccacccggaataccgctcggcgaagatcctggagcggatcatcgagccggagcgcgtcatcatgttccgtgtcccgtggctggacgacgcgggcgaggtccaggtgaaccgcggcttccgcatcgagatgaacagcgcgatcggcccgtacaagggcgggctgcgttttcacgcttccgtcaacctcggcatcctgaagttcctcgcgttcgagcaggtcttcaagaacgcgctgacgacgctgccgatggggggcggcaagggcggttccgacttcgatccgaaaggcaggagcgacgcggaagtcatgcgcttctgtcagagcttcatgacggagctggcgcggcacatcggcgcggacacggacgtgccggcgggcgacatcggcgtgggtggacgcgaaatcggttatctgttcgggcagtacaagcggatccgcaacgaattcgcgggcgtgctcacgggcaaggggctcaactggggcggctcgctgatccgtccggaggcgacggggtacggcgctgtctacttcgcggcggagatgctggcgacccgcagcgacaccctggcgggcaaggtgtgtctcgtgtcgggcagcggcaacgtcgcccagtacacggtcgagaagctgctcgcgcacggcgcgaaggtggtgaccctgtcggactccgctggtcacgtctacgacgaagccggcatgacggcggagaagctggcctatgtgatgaagctgaagaacgagcggcgcggccggatcgcggagtacgtcgagaagtatcgggacgcggtgtatacgccggccgatgccgcgcgtggcttcgatgcgctgtgggatcataaggccgactgcgcgtttccgagcgcgacgcagaacgagatcggccggcaggatgcgcagaatctgctgatcaacggcgtatacgtcgtgtcggagggcgcaaacatgccgtgcacgccggaagcggtcgaactgttcctcgaacacaatgtgctgtacggcccgggcaaagcggcgaacgcgggcggcgtggcggtctccggactcgagatgtcgcagaacagcatgcgcctgcgctggacgcgcgaggaagtcgatcaccggctgcagcagatcatgcacgagattcacgcgacgtgtctggcggcggcggagcggttcggcgctccgagcaattacgtgcacggcgcgaacatcgcgggattcctgaaggttgccgacgcgatgctcgatcagggtctcgtatag

SEQ ID NO: 166 - protein, 473 aa, Unknown
  Gene ID gdh_16 sequence from unknown bacterial species from environmental sample
MSSQVASPTRKLVRPPVSPATRDYIAALLAEVKAKNPAEPEFHQAVHEVAESVGLVLERHPEYRSAKILERIIEPERVIMFRVPWLDDAGEVQVNRGFRIEMNSAIGPYKGGLRFHASVNLGILKFLAFEQVFKNALTTLPMGGGKGGSDFDPKGRSDAEVMRFCQSFMTELARHIGADTDVPAGDIGVGGREIGYLFGQYKRIRNEFAGVLTGKGLNWGGSLIRPEATGYGAVYFAAEMLATRSDTLAGKVCLVSGSGNVAQYTVEKLLAHGAKVVTLSDSAGHVYDEAGMTAEKLAYVMKLKNERRGRIAEYVEKYRDAVYTPADAARGFDALWDHKADCAFPSATQNEIGRQDAQNLLINGVYVVSEGANMPCTPEAVELFLEHNVLYGPGKAANAGGVAVSGLEMSQNSMRLRWTREEVDHRLQQIMHEIHATCLAAAERFGAPSNYVHGANIAGFLKVADAMLDQGLV

SEQ ID NO: 167 - DNA, 1389 bp, Unknown
  Gene ID gdh_17 sequence from unknown bacterial species from environmental sample
atgcaggtcagcggcggcgtccgttcgaagccctcggcatacgtcaacgatgtgctcgcgcaggtgaaggcgaagaaccccgcggagccggaattccaccaggcggtcgaagaagtcctcgaaagcatcgaccttgccgtcgcgaagcgtcccgagctgcgcaaagcccgcatcctcgaacgcatcgtcgagcccgagcgcgtcgtgatgttccgcgtggcgtggcaggacgatgccggcgaggtgcagatcaatcgcgggtaccgcgtgcagatgaacagcgcgataggcccctacaaaggcggccttcggttccatcccagcgtgacgctcggggtgctgaagttcctcgcgttcgagcaggtcttcaagaactccctcaccacgctgcccatgggcggcgggaagggcggatccgatttcgatccgaaggggcgatcggacgccgaagtgatgcgcttctgccaggcgttcatgacggagctcgcgcgccacatcgggcccgacaccgacgtgccggccggcgacatcggtgtcggcgcgcgtgagattggctttctgttcgggcagtacaaacggctgcgcaacgaattcaccggcgtgctgaccgggaaggcgctgaactggggcggatcgctgatcaggccggaagccaccggctacggcgccgtgtatttcgcggcggagatgctggcgacgcgcaatcagacgctcgagggcaagacgtgtctcgtgtcgggcagtggcaatgtcgcgcaatacacgatcgagaagctgctggatctcggcgcgcgcgcggtgacggcgtccgattcagacggctatatctatgacgaagcggggttcgatcgcgcgaagctcgcaaagctgatggcgctgaaaaacgtgaagcgcggccggctgcgcgagtacgcggacgaggtgaagggcgtgacctacacgccggtgaagggcggcgccgcgcatccgatgtggtcgcatcgagccgactgcgcgttcccgagcgcgacgcagaacgagctctcgggacaggatgccgcgaacctcgtctcgaacaacatcacggccgtggccgagggggcgaacatgccctgcacgctcgacgccgtgcgcgtgttcatcgacgcgcgtgtgctctacgcgccggggaaggccgcgaacgccggcggcgtggcgacgtcgggcctcgagatggcgcagaacagcgcgcgtctgagctggacacgcgaggaagtggacggccgcctgcacaacatcatgaaagcgattcaccgcgcgtgccgcgacacggcggacgcgtacggcgcgcctggcaactacgtactcggcgcgaacatcgcgggcttcctcaaggtcgccgacgcgatgatggatcaggggctcgtctga

SEQ ID NO: 168 - protein, 462 aa, Unknown
  Gene ID gdh_17 sequence from unknown bacterial species from environmental sample
MQVSGGVRSKPSAYVNDVLAQVKAKNPAEPEFHQAVEEVLESIDLAVAKRPELRKARILERIVEPERVVMFRVAWQDDAGEVQINRGYRVQMNSAIGPYKGGLRFHPSVTLGVLKFLAFEQVFKNSLTTLPMGGGKGGSDFDPKGRSDAEVMRFCQAFMTELARHIGPDTDVPAGDIGVGAREIGFLFGQYKRLRNEFTGVLTGKALNWGGSLIRPEATGYGAVYFAAEMLATRNQTLEGKTCLVSGSGNVAQYTIEKLLDLGARAVTASDSDGYIYDEAGFDRAKLAKLMALKNVKRGRLREYADEVKGVTYTPVKGGAAHPMWSHRADCAFPSATQNELSGQDAANLVSNNITAVAEGANMPCTLDAVRVFIDARVLYAPGKAANAGGVATSGLEMAQNSARLSWTREEVDGRLHNIMKAIHRACRDTADAYGAPGNYVLGANIAGFLKVADAMMDQGLV

SEQ ID NO: 169 - DNA, 1338 bp, Unknown
  Gene ID gdh_18 sequence from unknown bacterial species from environmental sample
atggccgatgttaaggccaagaacccgatggagccggagttccatcaagccgtccaagaagtggtcgagtccctgtcgcttgttctcgatcaacaccctgaatatctaaaggcggggatcctggaacggatggtcgagccggaacgcgtcattatgttccgagtgccatggcaggacgataaaggcaatctccacgtcaatcgcggttttcgtgtccagatgaatagcgcgatcggcccgtataagggggggttgcggttccatccctccgtcaacctcggtattctcaagtttcttgccttcgaacaggtgtttaagaacgcgcttaccactctgccgatgggcggcgccaagggcggatctgacttcgatccgaaaggaaagagcgacttggaagtcacgcgcttctgccaggcttttatgtgcgaactttttcgccacatcgggccagacacagatgttcccgcgggggacatcggtgtcggcggccgcgaaataggatttctgttcgggatgtacaagaagcttggaaacgaattcacgggcgttttaaccggaaaaggcccaacttggggtggatccgtcatccgccccgaggccaccggatatggagcagtctatttcgcggccgaaatgctcgaaacccgcaaagaaaatcttaagggtaagacctgccttgtttccggaagcggcaatgtgtcgcaatatacggtcgataagctcatcgaggtcggggcgcggcccgtcacgctctcagactccaatggttatatctatgatgaggccggtattactcaggaaaagctcgcctttgtcatggagttaaaaaacgtccgccggggccgaattggcgagtacgcggacaaattcaaaagcgcgacttattttccgagggatccgaagctcgattacaacccgctctggaaccacaaggcggagtgtgcgttcccgagcgcgactcagaacgagattaacgcgaaggacgccgccaatctcctcaagaacggtgtctatgtcgtctcagaaggcgcaaatatgccgaccgcgatcgaagggatcaatcagttcatcgaggccaagatcctgttcggccccggcaaggccgcaaacgcgggcggtgtcgccacctctgggttggaaatggcgcagaacagcatgcgtatttcctggacgcgcgaggaagtggacgcgcggctgcagagcatcatgaaagggatccacaaaaattgttacgtgacggcggagaagtacggtactccgggcaactacgttaacggtgcgaacattgcgggtttcctgaaggtggctaacgccatgatggatcagggactggtgtag

SEQ ID NO: 170 - protein, 445 aa, Unknown
  Gene ID gdh_18 sequence from unknown bacterial species from environmental sample
MADVKAKNPMEPEFHQAVQEVVESLSLVLDQHPEYLKAGILERMVEPERVIMFRVPWQDDKGNLHVNRGFRVQMNSAIGPYKGGLRFHPSVNLGILKFLAFEQVFKNALTTLPMGGAKGGSDFDPKGKSDLEVTRFCQAFMCELFRHIGPDTDVPAGDIGVGGREIGFLFGMYKKLGNEFTGVLTGKGPTWGGSVIRPEATGYGAVYFAAEMLETRKENLKGKTCLVSGSGNVSQYTVDKLIEVGARPVTLSDSNGYIYDEAGITQEKLAFVMELKNVRRGRIGEYADKFKSATYFPRDPKLDYNPLWNHKAECAFPSATQNEINAKDAANLLKNGVYVVSEGANMPTAIEGINQFIEAKILFGPGKAANAGGVATSGLEMAQNSMRISWTREEVDARLQSIMKGIHKNCYVTAEKYGTPGNYVNGANIAGFLKVANAMMDQGLV

SEQ ID NO: 171 - DNA, 1362 bp, Unknown
  Gene ID gdh_19 sequence from unknown bacterial species from environmental sample
atgaatgactacgtcacagcgttgatggccgaggtaaaggccaagaacccatcggagcccgagtttcaccaggcggtcgaggaggtggtagagtcgctcgcgctcgtcctggaacaacatccggaataccggaaagcgaaaatcatcgagcgaatcattgagccggagcgggtcatcatcttccgcgttccctggcaggacgaccagggcgagctgcaggtgaaccgcgggtttcgcattcagatgaacagcgccatcggcccgtacaagggcggcctgcgtttccatccttcggtcaacctcggcatcctaaaattcctcgctttcgaacaggtgttcaaaaacgcgctcaccactctgccgatgggcggcggcaaaggcggttccgacttcgatccgaaaggcaagagcgacagtgaagtgatgcgcttctgtcaggcgttcatgtgcgaactgttccggcacattggcccggataccgatgttcccgcgggcgatatcggcgtcggggcacgtgaaatcggatacttgttcgggatgtacaagaggctcaggaacgagttcagcggtgtgataacgggcaagggtctgacctggggtgggtccgtcattcgccctgaggcgacgggctacggcgcggtttatttcgcggctgaaatgctcaagacgcgcaaagaagagatgaagggcaaaacctgtctcgtgtccgggagcggcaatgtttcgcagtacacggtggacaaacttatctcgctgggggccaaggcagtcacactctcggattcatctggctacatctacgacgaggccgggatcgaccgcgacaagcttgcctttgtcatggacctgaagaacaaccggcgtggccggatttcagaatacgccgataagttcaaggggacgaccttcacggccgtggacgaggcgctcgatcataacccgctttgggatcacaaggccgagtgcgcctttcccagtgcaacgcagaacgagatcaacgggaaggacgcggcgaaccttctccgaaacggcgtctatgtcgtctcggagggggcgaatatgccgactacgattgacggcgtaaaccagttcctcgaggcgcagatcctcttcggtcctggcaaagcagcaaatgccggcggagttgcgacctccggcttggagatggcgcaaaacagcatgcggatttcctggacccgcgaggaagtggataaccgtctcttcaatatcatgaagacgatccacgaagtttgccatcgcacggccgagaagtacggcacgccgggcaactacgtgaacggcgcaaacattgccggctttcagaaagtcgccaacgcgatgatggaccagggactggtgtag

SEQ ID NO: 172 - protein, 453 aa, Unknown
  Gene ID gdh_19 sequence from unknown bacterial species from environmental sample
MNDYVTALMAEVKAKNPSEPEFHQAVEEVVESLALVLEQHPEYRKAKIIERIIEPERVIIFRVPWQDDQGELQVNRGFRIQMNSAIGPYKGGLRFHPSVNLGILKFLAFEQVFKNALTTLPMGGGKGGSDFDPKGKSDSEVMRFCQAFMCELFRHIGPDTDVPAGDIGVGAREIGYLFGMYKRLRNEFSGVITGKGLTWGGSVIRPEATGYGAVYFAAEMLKTRKEEMKGKTCLVSGSGNVSQYTVDKLISLGAKAVTLSDSSGYIYDEAGIDRDKLAFVMDLKNNRRGRISEYADKFKGTTFTAVDEALDHNPLWDHKAECAFPSATQNEINGKDAANLLRNGVYVVSEGANMPTTIDGVNQFLEAQILFGPGKAANAGGVATSGLEMAQNSMRISWTREEVDNRLFNIMKTIHEVCHRTAEKYGTPGNYVNGANIAGFQKVANAMMDQGLV

SEQ ID NO: 173 - DNA, 1362 bp, Unknown
  Gene ID gdh_20 sequence from unknown bacterial species from environmental sample
atgaatgaccatgtcgctgcgttgatggccgaggtaaaggccaagaacccctcggagccggaatttcaccaggcggtggaggaggtggccgagtcgctcacgctggtgctggatcagcatccggaatatcggaaggcaaagatcctcgagcgaatcatcgagccggagcgcgtgatcatgtttcgcgttccctggcaggatgacgcgggggagctgcacgtgaatcgcgggttccgcatccagatgaacagcgcgattggcccatacaaaggcggcctgcgtttccatccctcggtcaacctcggcatcctgaagttcctcgccttcgagcaggtctttaagaacgcgctgaccacgctgccgatgggcggcggaaagggtggggccgactttgatccgaaagggaaaagcgacagcgaggtaatgcggttctgccaggccttcatgtgcgagctgttccggcacatcggcccggatacggatgtgccggcgggcgatattggcgtcggggcacgcgagatcggatttctttttgggatgtacaagaggctgaagaacgagttcaccggtgtgatgacgggcaaaggcctcacctggggtggctcggtcattcgtcctgaggcgacgggatacggcgcagtctatttcgcggctgagatgctcaagacgcgcaaggaagagatgaagggcaagacgtgtctcgtctcgggaagcggcaacgtttcgcagtacacggtggacaaacttatctcgctgggcgcaaagacggtcacgctctcggattcatccggctacatctatgacgaggccgggatcgaccgggacaagctcgcctttgtcatggatctgaagaacaaccgccgcgggcggatcgcggaatatgccgacaagttcaagggcgcggtcttcacgccattggatgaggcgctcgatcataaccccctctggaatcacaaggccgagtgcgcctttcccagcgccacgcaaaacgagatcaacgggaaggacgcggcgaaccttctccggaacggcgtctacgtcatctccgagggcgcaaacatgccgaccacaactgacggcgtcagccggttcctcgaggcgcaggtccttttcggtcccgggaaggccgccaatgccggcggagtcgcgacttccggattggaaatggcgcaaaacagcatgcggatttcctggacccgcgaggaagtggataaccgtcttttcaatatcatgaagacgatccacgaaaattgctatcgcacggccgagaaatacggcacgccgggtaactacgtcaacggtgcgaacatcgccggcttcctcaaggtcgcgaacgcgatgatggaccagggattggtgtag

SEQ ID NO: 174 - protein, 453 aa, Unknown
  Gene ID gdh_20 sequence from unknown bacterial species from environmental sample
MNDHVAALMAEVKAKNPSEPEFHQAVEEVAESLTLVLDQHPEYRKAKILERIIEPERVIMFRVPWQDDAGELHVNRGFRIQMNSAIGPYKGGLRFHPSVNLGILKFLAFEQVFKNALTTLPMGGGKGGADFDPKGKSDSEVMRFCQAFMCELFRHIGPDTDVPAGDIGVGAREIGFLFGMYKRLKNEFTGVMTGKGLTWGGSVIRPEATGYGAVYFAAEMLKTRKEEMKGKTCLVSGSGNVSQYTVDKLISLGAKTVTLSDSSGYIYDEAGIDRDKLAFVMDLKNNRRGRIAEYADKFKGAVFTPLDEALDHNPLWNHKAECAFPSATQNEINGKDAANLLRNGVYVISEGANMPTTTDGVSRFLEAQVLFGPGKAANAGGVATSGLEMAQNSMRISWTREEVDNRLFNIMKTIHENCYRTAEKYGTPGNYVNGANIAGFLKVANAMMDQGLV

SEQ ID NO: 175 - DNA, 1362 bp, Unknown
  Gene ID gdh_21 sequence from unknown bacterial species from environmental sample
atgaatgaccaagttgcagcgttgatggccgatgttaaggccaagaatccgggggagccggaatttcaccaggccgtccaggaagtagtcgaatcgctcacgctcgttctggatcagcacccggaatatcgtaaggcgaagatcatcgagcggatcattgagccggagcgggtcatcatcttccgcgttccctggcaggacgatcagggcgagctgcatgtcaaccgcggcttccgcatccaaatgaacagcgcgatcggcccctacaaaggcggtctgcgctttcatccctccgtcaacctgggcattctgaagtttctcgctttcgagcaggtgttcaagaatgcgctcaccacgttgcccatgggcggcggcaaaggcggggctgacttcgatccgaaaggcaagagcgacagcgaagtgatgcgtttctgccaggcgttcatgtgtgaactcttccggcacatcggcccggatacggacgtgccggcgggcgacatcggcgtcggggcgcgtgagatcggatttttgttcgggatgtacaagaggctcaagaacgagttcaccggcgtgatgaccggcaaaggtcttacttggggcggctcggtcattcgtccggaggcgacgggatacggggcggtctatttcgcagctgaaatgctcaagacgcgcaaggaagagatgaagggcaagacctgtctcgtttccggaagcggcaacgtttcgcagtacacggtggacaaactgatctcgctcggggcgaaggcggtcacgctctcggattcatccggctatatctatgacgaagccgggatcgaccgggagaagctcgcctttgtcatggacctgaagaaccaccgccgcggccgcatctccgaatatgccgacaagttcaaaggaacgaccttcaccgcagtggacgaggcgctcgatcataacccaatttgggatcacaaggcggagtgcgcgtttccgagcgcgacccagaacgaaatcaacgggaaggatgctgcaaatctcctgaagaacggcgtctacgtcgtctccgaaggcgcgaacatgccgaccacgatcgatggagtaaataaatttctcgaggcgaatatcttgttcggtccggggaaggccgcgaatgccggcggagtcgccatctccggattggagatggcgcaaaaaagcatgcgtatctcgtggactcgcgaagaagtcgacacgcgtctgttcaacatcatgcggacgatccacgaaaactgccatcgcacctccgagaagtacggcaccccaggtaactacgtcaacggcgcgaacatcgccggcttcctgaaagtcgcgaacgccatgatggaccagggattggtctag

SEQ ID NO: 176 - protein, 453 aa, Unknown
  Gene ID gdh_21 sequence from unknown bacterial species from environmental sample
MNDQVAALMADVKAKNPGEPEFHQAVQEVVESLTLVLDQHPEYRKAKIIERIIEPERVIIFRVPWQDDQGELHVNRGFRIQMNSAIGPYKGGLRFHPSVNLGILKFLAFEQVFKNALTTLPMGGGKGGADFDPKGKSDSEVMRFCQAFMCELFRHIGPDTDVPAGDIGVGAREIGFLFGMYKRLKNEFTGVMTGKGLTWGGSVIRPEATGYGAVYFAAEMLKTRKEEMKGKTCLVSGSGNVSQYTVDKLISLGAKAVTLSDSSGYIYDEAGIDREKLAFVMDLKNHRRGRISEYADKFKGTTFTAVDEALDHNPIWDHKAECAFPSATQNEINGKDAANLLKNGVYVVSEGANMPTTIDGVNKFLEANILFGPGKAANAGGVAISGLEMAQKSMRISWTREEVDTRLFNIMRTIHENCHRTSEKYGTPGNYVNGANIAGFLKVANAMMDQGLV

SEQ ID NO: 177 - DNA, 1362 bp, Unknown
  Gene ID gdh_22 sequence from unknown bacterial species from environmental sample
atgaaagacgacgtttccgcattgatgtccgaggtcaaagccaagaacccgggagaaccagagttccatcaggctgttcaggaagtatcggaatctctagcgctcgtgctcgatcagcatcccgaatatcggaaagccaagatcctcgagcggatcattgagccggagcgcgtaatcatgtttcgcgtgccctggcaagacgaccagggtgagctccacgtcaatcgcgggttccgcatccaaatgaacagcgcgattgggccttacaagggcggcctccgatttcatccttcggtgaacctcggcatcctgaaattcctcgccttcgagcaggtctttaagaatgcgcttaccaccttgcccatgggaggcgggaagggcggggcggatttcgatccgaaagggaagagcgacagtgaagtgatgcgcttctgccaggcgttcatgtgtgagctgtttcggcatattgggccggacacagatgtgccggcgggtgacattggcgtgggcgcgcgcgagatcgggtttcttttcgggatgtttaagcggttaaagaatgagttcaccggcgtgatgacgggcaaaggcctcacgtggggcggctcggtcattcgaccggaagcgacgggatacggcgcggtttactttgccgccgagatgctcaagacgcgcaaggaagagctagccggtaagacttgtcttgtttcgggcagcggcaacgtcgcgcaatacacggtcgataaacttatctcgctaggcgcgaaggcggtcactctctcggattccacgggttacatttacgatgaggctggcatcaatcgggaaaagctcgcctttgtcatggatcttaagaacaaccggcgcgggcggatcgcggaatacgcggataagttcaagggggcgactttcacgcccctgaacgaaacgctcgatcacaatccgctttgggagcacaaggccgaatgcgcctttcccagcgcgacccagaacgagatcaacggaaaggacgcagcgaatcttctgcgcaacggcgtctatgtggtttcagaaggcgcgaacatgcccacgaccatcgacggcgtgaatcagttcctggaagcacaaatccttttcggcccgggcaaggcggcgaatgcgggtggcgtcgccacttcgggactcgagatggcgcaaaacagcatgcgcatttcctggacacgcgaggaagtggacgcgcgcctgttcaacatcatgaagacgatccacgaggtctgccaccggacagctgagaagtacggcacgccggggaattatgtgaacggcgccaacattgcgggctttctcaaggtcgcgaacgcgatgatggatcagggattagtgtag

SEQ ID NO: 178 - protein, 453 aa, Unknown
  Gene ID gdh_22 sequence from unknown bacterial species from environmental sample
MKDDVSALMSEVKAKNPGEPEFHQAVQEVSESLALVLDQHPEYRKAKILERIIEPERVIMFRVPWQDDQGELHVNRGFRIQMNSAIGPYKGGLRFHPSVNLGILKFLAFEQVFKNALTTLPMGGGKGGADFDPKGKSDSEVMRFCQAFMCELFRHIGPDTDVPAGDIGVGAREIGFLFGMFKRLKNEFTGVMTGKGLTWGGSVIRPEATGYGAVYFAAEMLKTRKEELAGKTCLVSGSGNVAQYTVDKLISLGAKAVTLSDSTGYIYDEAGINREKLAFVMDLKNNRRGRIAEYADKFKGATFTPLNETLDHNPLWEHKAECAFPSATQNEINGKDAANLLRNGVYVVSEGANMPTTIDGVNQFLEAQILFGPGKAANAGGVATSGLEMAQNSMRISWTREEVDARLFNIMKTIHEVCHRTAEKYGTPGNYVNGANIAGFLKVANAMMDQGLV

SEQ ID NO: 179 - DNA, 1338 bp, Unknown
  Gene ID gdh_23 sequence from unknown bacterial species from environmental sample
atggccgaggtcaaagccaagaacccgggcgaagccgagtttcaccaggcagtccaggaagtcgctgaatcgctggcgctggtgctcgatcagcacccggaatatcggaaggcgaaaattctggagcgaatcatcgagccggagcgcgtcatcatgtttcgggtgccgtggcaggacgaccagggcgagctccatgtgaaccgcgggtttcggattcagatgaacagcgcgatcgggccttacaagggcgggctccgttttcatccgacggtgaatcttggcatcctgaagttcctcgctttcgagcaggtctttaaaaatgcgttgaccacgttgccgatgggcggcggcaaaggcggttcggatttcgatcccaaaggcaaaagcgacagcgaagtgatgcgcttctgtcaggcgttcatgtgcgagctgttccggcacatcggtccggacacggacgtgccagcgggcgacatcggcgttggtgcgcgcgagattggatttttgttcgggatgtataagcggcttcggaacgagttcacgggcgtcatcaccggcaaaggccttacctggggcggctcggtgattcgtcccgaagcgaccggttatggggcggtttatttcgcggcggagatgctgaagacacgcaaggaagaattgaaaggcaagacctgtttggtttccggcagcggcaatgtcgcccagtacacagtggacaagctgatctcgttaggcgcgaaagccgtcacgctttcggattccactggctacatcttcgacgaagccgggatcgatcgtgacaagctcgcgttcgtcatggatttgaagaacaaccgccgcggccgcatttccgaatacgcggacaagttcaaaggggcggtcttcacggcggttgaggcggcggcggatcataatccgctttgggatcacaaagctgagtgcgcatttccgagcgcgacgcagaacgagatcaacgcgaaggatgccgcgaaccttttgcggaacggcatctacgtcgtctcggaaggggcgaacatgccgaccacgatcgatggcgtgaaccagttcctcgatgcgaacatcctgttcggcccgggcaaggcggccaacgcgggcggtgtggcaacttccggcttggaaatggcgcaaaacagcatgcgcatctcctggacgcgcgaagaagtcgatggccggcttttcaatatcatgaaaaccatccacgaagtttgccaccgcacggccgagaagtacggcacgccgggcaactacgtgaacggcgcgaacatcgccggcttcctcaaggtggcgaacgcgatgatggaccaggggttggtgtag

SEQ ID NO: 180 - protein, 445 aa, Unknown
  Gene ID gdh_23 sequence from unknown bacterial species from environmental sample
MAEVKAKNPGEAEFHQAVQEVAESLALVLDQHPEYRKAKILERIIEPERVIMFRVPWQDDQGELHVNRGFRIQMNSAIGPYKGGLRFHPTVNLGILKFLAFEQVFKNALTTLPMGGGKGGSDFDPKGKSDSEVMRFCQAFMCELFRHIGPDTDVPAGDIGVGAREIGFLFGMYKRLRNEFTGVITGKGLTWGGSVIRPEATGYGAVYFAAEMLKTRKEELKGKTCLVSGSGNVAQYTVDKLISLGAKAVTLSDSTGYIFDEAGIDRDKLAFVMDLKNNRRGRISEYADKFKGAVFTAVEAAADHNPLWDHKAECAFPSATQNEINAKDAANLLRNGIYVVSEGANMPTTIDGVNQFLDANILFGPGKAANAGGVATSGLEMAQNSMRISWTREEVDGRLFNIMKTIHEVCHRTAEKYGTPGNYVNGANIAGFLKVANAMMDQGLV

SEQ ID NO: 181 - DNA, 1362 bp, Unknown
  Gene ID gdh_24 sequence from unknown bacterial species from environmental sample
atgaaatacgatgtctccgctttgatggccgaggttaaggccaagaacccgggcgaacccgagtttcaccaggccgtccaggaagtcgtcgaatcgctggccctcgtcctggagcagcatcccgaatatcagaaagccaagatcatcgagcggatcatcgaacccgagcgcgtgatcatgttccggatcccgtggcaggacgacaaaggcgagctccatgtgaaccgcgggttccgcatccagatgaacagcgccatcgggccctacaagggcggcctccggtttcatccgtcggttaatctgggcatcctgaagttcctcgccttcgagcaggttttcaaaaacgcgcttaccactcttccaatgggcgggggcaaaggcggctctgacttcgatccaaaaggaaagagcgacagcgaagtgatgcggttttgccaggcgttcatgtgcgagctgtttcgtcacatcggcccggatacggacgtgccggccggcgatatcggggtaggcgcgcgcgagatcggctttcttttcgggatgtataagagactgaagaatgaattcaccggagtgatgacgggcaagggtctcacctggggcggctcggtcattcgtcctgaagccaccggatacggcgcggtttatttcgccgcggaaatgctcaagacgcgcaaggaagagctcaaaggcaagacctgtctcgtttccggcagcggcaacgtcgcgcaatacaccgtcgacaaactgatctcgttaggcgcgcaggcggtcacgctctcggattcgaccggttacatctacgacgaagccgggatcgaccgcgacaagctcgcctttgtcatggacctcaagaacaaccggcgcggccggatcagcgaatacgccgacaagttcaaaggggccgagttcattccggcggatgcgaagcgcgaccataaccccctttgggatcacaaggccgagtgcgctttcccgagcgcgacccagaacgaaattaacgagaaggacgcggcgaacctgatcaagaacggcgtctatgtcgtctcggaaggcgcgaacatgccgaccacgatcgatggcgtgaaccagttcctgaaagccggtatccttttcgggcccggaaaagcggccaatgccggaggggttgcgacctccggtttggaaatggcgcagaacagcatgcgcatttcctggacccgcgaagaagtcgacgggcgcctcttcaacatcatgaagaccatccacgaagtctgtcatcgcaccgcggaaaagtacggcacgcccggcaactacgtgaacggcgcgaacatcgccggcttcctcaaagtggccaacgcgatgatggaccaggggctggtgtaa

SEQ ID NO: 182 - protein, 453 aa, Unknown
  Gene ID gdh_24 sequence from unknown bacterial species from environmental sample
MKYDVSALMAEVKAKNPGEPEFHQAVQEVVESLALVLEQHPEYQKAKIIERIIEPERVIMFRIPWQDDKGELHVNRGFRIQMNSAIGPYKGGLRFHPSVNLGILKFLAFEQVFKNALTTLPMGGGKGGSDFDPKGKSDSEVMRFCQAFMCELFRHIGPDTDVPAGDIGVGAREIGFLFGMYKRLKNEFTGVMTGKGLTWGGSVIRPEATGYGAVYFAAEMLKTRKEELKGKTCLVSGSGNVAQYTVDKLISLGAQAVTLSDSTGYIYDEAGIDRDKLAFVMDLKNNRRGRISEYADKFKGAEFIPADAKRDHNPLWDHKAECAFPSATQNEINEKDAANLIKNGVYVVSEGANMPTTIDGVNQFLKAGILFGPGKAANAGGVATSGLEMAQNSMRISWTREEVDGRLFNIMKTIHEVCHRTAEKYGTPGNYVNGANIAGFLKVANAMMDQGLV

SEQ ID NO: 183 - DNA, 1008 bp, Cronobactor sakazakaii
atgatcgacctgcgctccgacaccgttacgcgccctggtaaggcgatgctggaacgtatgatggcggcacctacgggtgatgacgtatatggtgatgacccgaccgtgaatgcgcttcaggattacgcggcgcgtctttctggtaaggaggcggccttattcttacctacgggaacacaagcaaatctggtggctttattaagccactgcgagcgtggtgaggagtacattgttggtcagttggctcataactacctgtacgaagctggaggggccgccgtgttgggctctatccagccacaaccaatcgaagctgatgtggacggtactttacccctggacaaggtcgcagcgaaaatcaagccggatgatattcactttgcgcgcacgcgcctgctgagtttggaaaacactcataatggcaaagtcctgcctcgtgattacttacaacaggcatggggatttacgcgcgagcgcggtcttgcgttgcatgtcgatggggcacgtatctttaatgcggtagtcgcatacggctgtgaattaaaggagattgctcaatactgcgataccttcactatttgtttgagcaaaggattgggtgctccagtaggatctttgttggtagggagtcacgattatattaagcgcgccaagcgctggcgcaaaatgactggcggaggaatgcgccaagcggggattttagccgctgcaggcttatatgcgcttgagcacaacgttgcacgccttaaagaggaccacgacaatgcagcctggttggcggctgcgttgcgcgatgctggggctgaggtacgtcgccatgacaccaatatgttatttgtctccgtgcctcaagctcaggttgcagcccttggagcctttatgaaatctcgcaacgttttaatttccgcagctcctgttactcgtttggttactcatcttgacgttaatcgtgagcagcttgaaacggttgtagcctattggcgtgaatttctgcagcaaacagcctaa

SEQ ID NO: 184 - protein, 335 aa, Cronobactor sakazakaii
MIDLRSDTVTRPGKAMLERMMAAPTGDDVYGDDPTVNALQDYAARLSGKEAALFLPTGTQANLVALLSHCERGEEYIVGQLAHNYLYEAGGAAVLGSIQPQPIEADVDGTLPLDKVAAKIKPDDIHFARTRLLSLENTHNGKVLPRDYLQQAWGFTRERGLALHVDGARIFNAVVAYGCELKEIAQYCDTFTICLSKGLGAPVGSLLVGSHDYIKRAKRWRKMTGGGMRQAGILAAAGLYALEHNVARLKEDHDNAAWLAAALRDAGAEVRRHDTNMLFVSVPQAQVAALGAFMKSRNVLISAAPVTRLVTHLDVNREQLETVVAYWREFLQQTA

SEQ ID NO: 185 - DNA, 1041 bp, Unknown
  ltaE_1 sequence from unknown bacterial species from environmental sample
atgagagaaatcgacctgcgcagcgataccgtcacacgcccttccgccgccatgcgtgcggccatggccgcggccgaggtgggggacgacgtctacggtgaagacccgaccgtcaaccagctcgaggcgctcgcagcggagatgctcggcatggatgcggggttgttcgtgccatcgggcacgcagggcaacctgctcggcgtgatgtcccactgcgagcgcggcgacgaatacatcgtcgggcaacaggcgcatacctataagtacgaggggggcggcgctgccgtgctgggcagcatccagccacagccgctcgagttccagcgggatgggacgctcgatctcgctcaagtcgccaacgcgatcaaacctgacgacacgcactttgcgcggacgcgtctcctgtgcctcgaaaacactcaggatggcaagccgctgccgctggaatatctggagcgcgcccatgcgttcgcgcgcgaacgcaggctcgggttgcacctggacggcgcccggctgttcaacgccgcggtggaccaggaggtggcgccgcagcgaatcgcgcgcctctttgacaccgtatcagtgtgtctgtcgaaaggtctcggcgcgccggtcggatcggtgttgtgcggaaccgccgcgcatatgaccaaggcgagacgctggcggaaagtgctcggtggcgggatgcgacaggctggcgtgctggcggccgccggcatctacgcgctgcagaacaacgtcaatcggcttgctgaggatcatgcgaacgcacggctcctcgcgacgctcctctcgcgaatcgacaaggtcaccgtggagtccgtccagaccaacatggtcttcgccagggtcgacccgtcgcacgagccgcacctgcgccagttcctcacgcatcgacatatccggatccaccccggcccccggctcaggctggtcacccatctcgacgtccaacgcgacgacgtggttgcctttgccgacgcggtgacggccttctacgcagggagcctgccgccaacggtcgccgcgcaggcctga

SEQ ID NO: 186 - protein, 346 aa, Unknown
  ltaE_1 sequence from unknown bacterial species from environmental sample
MREIDLRSDTVTRPSAAMRAAMAAAEVGDDVYGEDPTVNQLEALAAEMLGMDAGLFVPSGTQGNLLGVMSHCERGDEYIVGQQAHTYKYEGGGAAVLGSIQPQPLEFQRDGTLDLAQVANAIKPDDTHFARTRLLCLENTQDGKPLPLEYLERAHAFARERRLGLHLDGARLFNAAVDQEVAPQRIARLFDTVSVCLSKGLGAPVGSVLCGTAAHMTKARRWRKVLGGGMRQAGVLAAAGIYALQNNVNRLAEDHANARLLATLLSRIDKVTVESVQTNMVFARVDPSHEPHLRQFLTHRHIRIHPGPRLRLVTHLDVQRDDVVAFADAVTAFYAGSLPPTVAAQA

SEQ ID NO: 187 - DNA, 1017 bp, Unknown
  ltaE_2 sequence from unknown bacterial species from environmental sample
gtgaagatagtcgatctgcgcagtgacaccgtgacccggccgtcgccaggcatgcgtgccgccatggctgcggcggaagtcggggacgacgtctacggcgaggaccccacggtcaaccgtctcgaagcgatgaccgccgagatgctcggcaaggaagccgcgatcttcgtctgcagcggcacgcagagcaacctgctcgcgctgatgtcccattgcgagcgcggcgacgagtacatcgtcggacagcaagcgcacacctacaagttggaaggcggcggggcggcggtgctcggcagcatccagccgcagccgctggactacgagccggatggatcgctcgacctcacccgtgtcgaagccgcgatcaagcccgatgatccacatttcgccaagacccgcctgctgtgtctggagaacacccaggccggcaaggtgctgtcgctcgactacctcgcgcgcgcgggccagttcgcccgggcgaacggacttcgcctgcatctcgacggcgcgcgcatcttcaacgcggcggtcgatctcggcgtcgcggtcatcgagatcagccggcatttcgactcggtatcggtgtgtctgtcgaaggggctcggcgcgccggtcggctcgatcctgtgcggcacgcgtgagcggatcgtcagcgcgcggcgctggcgcaaagtgctcggcggcggcatgcgccaagccggcgtgctggcggcggcggggatctacgcgctcgagcacaacatcgagcggttggccgaggatcacgagaacgcgcgcgcgctcgtcgacggaatggcggagatcgacgagctgaagacggacggtccacacaccaacatggtgtacatcgcgctcgagccgcggcggtccgtggcgatgcgcaactatctggaagagcgtggcatgcgggtgaagggccagggaaccatgcggctggtgacgcacctcgacgtcgatcggagcgacatccagcgattcgtggcagcggcgaagcagttcttcgccgacgcggcctga

SEQ ID NO: 188 - protein, 338 aa, Unknown
  ltaE_2 sequence from unknown bacterial species from environmental sample
VKIVDLRSDTVTRPSPGMRAAMAAAEVGDDVYGEDPTVNRLEAMTAEMLGKEAAIFVCSGTQSNLLALMSHCERGDEYIVGQQAHTYKLEGGGAAVLGSIQPQPLDYEPDGSLDLTRVEAAIKPDDPHFAKTRLLCLENTQAGKVLSLDYLARAGQFARANGLRLHLDGARIFNAAVDLGVAVIEISRHFDSVSVCLSKGLGAPVGSILCGTRERIVSARRWRKVLGGGMRQAGVLAAAGIYALEHNIERLAEDHENARALVDGMAEIDELKTDGPHTNMVYIALEPRRSVAMRNYLEERGMRVKGQGTMRLVTHLDVDRSDIQRFVAAAKQFFADAA

SEQ ID NO: 189 - DNA, 1101 bp, Unknown
  ltaE_3 sequence from unknown bacterial species from environmental sample
gtgtcaattagcgtggtggagatcggattgaccggtctcaggccgccgctaattggcggcatgaagacgatcgatttgcgcagcgacacggtgacccggccctgtgaagggatgcggcgggcgatggcggccgcggaggtcggagatgatgtgtttggcgacgatccgaccgtgcgtcgtctcgaggcgctggctgcggaaatgctggggaaggaagcggcggtgttcgcggcgagcggcacgcagaccaatctcatctccctcctgacacattgcgggcgcggcgacgagtatatcgtcgcccagcaggcgcacacgtatctccacgagggcggtggcggcgcggcgctgggcggcatccagccccagccgctcgattgtctcccggatggcaccctcgaccttgccaaagtcgaagcgcttatcaagccggacgactctcactacgcccgcaccagactgctttgcctcgagaacaccatcggtggccgtgcgctgccggcggactatcctgacaaggcccgcgcgttgaccgaccgccgcggactacgcctccatctcgatggcgcccgcatcttcaatgctgcgatcaagcagaaccggcccgttgcggaactcgcgcggccgtttcacagcgtatcactctgcctctcgaagggactcggcgcgccggtgggttcgctgctgctggggagcgaagacttcatccgcgaggcccgccgctggcgaaaagtcgtcggcggcggcatgcgtcaggcgggaattctggcggcggccggcattttcgccctgaccaaaaacgtcgcccggctcgcagacgaccacgagaatgcccggcgcctcgccgacggcctcgcaggcctggacggcggccgctttttcgtcgatcctgccgctgtgcagacgaacatggtttttgtcaggctcaacggcatcgatgccgcgacgctggcggcacatcttgcggaggcgggcatcctcattctcaaaggaaatcccctgagactcgtcacgcatcgcgacgtcgaggccacggatatcgagcgtgcgatccgcgccttcgcaacgtttccgccagggccagattcagtgaatctgtga

SEQ ID NO: 190 - protein, 366 aa, Unknown
  ltaE_3 sequence from unknown bacterial species from environmental sample
VSISVVEIGLTGLRPPLIGGMKTIDLRSDTVTRPCEGMRRAMAAAEVGDDVFGDDPTVRRLEALAAEMLGKEAAVFAASGTQTNLISLLTHCGRGDEYIVAQQAHTYLHEGGGGAALGGIQPQPLDCLPDGTLDLAKVEALIKPDDSHYARTRLLCLENTIGGRALPADYPDKARALTDRRGLRLHLDGARIFNAAIKQNRPVAELARPFHSVSLCLSKGLGAPVGSLLLGSEDFIREARRWRKVVGGGMRQAGILAAAGIFALTKNVARLADDHENARRLADGLAGLDGGRFFVDPAAVQTNMVFVRLNGIDAATLAAHLAEAGILILKGNPLRLVTHRDVEATDIERAIRAFATFPPGPDSVNL

SEQ ID NO: 191 - DNA, 1047 bp, Unknown
  ltaE_4 sequence from unknown bacterial species from environmental sample
atgctagtggatgacttccgttcggatacggtcacacgccccgatgaggggatgcgttctgccatggctgcggccgaggttggcgacgcagtctacgatgactgcccgaccaccaagcgcctggaagccatggccgccgagcgattgggaaaggaagcctcgcttttcttccccaccggcacgcaagcgaacctggccgggctcatggcccattgcggccgcggcgacgaatatctcgttggccagatggctcacacctatcggctcgagggcggcggcgccgcagtcctggggtcgatccagccgcagcccctgcccaacgagccagatgggacgatcgcgctggacgccatttcgaacgcgatcaagccaaacgactttcactttgcagtcacacggctgctggccctggaaaatacgttcaacggcctggtgctgtccgacgcatacctgcaagccgcaactcaactcgcccgctctcgcgggcttgcgacgcatctggacggtgcccggttgatgaacgctgcagcggcgagcggccgggacgcggcatggatcgcggcgcagttcgacaccgtttccatgtgtctctccaaggggctgggagcgccggttggatccgtcctcatcggccccagggacttcatcaaaaaggcccgccggatcaggaaaatgctgggcggtggcatgcgccagaccggcgtgctcgccggggccgcgatctatgcattggagcacaacgtcgcgcggctcagtgaagatcatcggcgcgccgctgatctcgcgactgtgctggcgcgttttcccgagctgggcgcgggaccgtcacgaacgaacatggtgttcatgacgcccaaggggctcgacgttagcgctttcgtcgcgtttctgcgcggccgcggcatcgccgtcagcgggagatatggaacgctgcgttgggtgacccatctggacgttggtgacgattccgtggagcgggtcgccgaggcctgcgaggtcttctttgaagggcaaaacgcggccgccggattgagagtgcaagcctaa

SEQ ID NO: 192 - protein, 348 aa, Unknown
  ltaE_4 sequence from unknown bacterial species from environmental sample
MLVDDFRSDTVTRPDEGMRSAMAAAEVGDAVYDDCPTTKRLEAMAAERLGKEASLFFPTGTQANLAGLMAHCGRGDEYLVGQMAHTYRLEGGGAAVLGSIQPQPLPNEPDGTIALDAISNAIKPNDFHFAVTRLLALENTFNGLVLSDAYLQAATQLARSRGLATHLDGARLMNAAAASGRDAAWIAAQFDTVSMCLSKGLGAPVGSVLIGPRDFIKKARRIRKMLGGGMRQTGVLAGAAIYALEHNVARLSEDHRRAADLATVLARFPELGAGPSRTNMVFMTPKGLDVSAFVAFLRGRGIAVSGRYGTLRWVTHLDVGDDSVERVAEACEVFFEGQNAAAGLRVQA

SEQ ID NO: 193 - DNA, 1035 bp, Unknown
  ltaE_5 sequence from unknown bacterial species from environmental sample
atgagcccaatccgccacgatttccgctccgacaccgttacgcgtccgagccccgctatgcgggaggcgatggggcgggccgaggtcggcgacgacgtgtttggcggggatccgaccgtgaacgcgctcgaggccgagaccgccgaactgctaggcaaagaggccgggctattcctaccgtccggcacgcaatcgaacctcgtcgccctgatggcccattgtgggcggggcgacgaatacatcacgggccagcaggcgcattgctataggtgggaagcgggcggggctgccgtgctcggctcaatccagccgcagccgatcgccaatgccgctgacggcaccctcccgctcgccgagatcgaagcggctatcaagccggacgatccgcattacgcgacgacccggctcctggcactcgagaacacgatcggcggcaaggtcctgccgcaggattacgtgattgcggctaccgcgctcgcccggaagcacaggctggcctgccacctcgacggcgcccggctgtgcaatgccgctgtggcacagaacacgagcgcggccgagctcgccgcgccgttcgacacggtttcgctctgcctctcgaaggggctgggcgcgcccgtcggatcggtgctggtcgggccgcgcgacctgatcggcaaggcgcgccgcatccggaagatggtgggcgggggcatgcgccaggcgggcgtgattgcggcgggtgccctctatgcactccgccacaacatcgctcggctcgcggacgaccacgccaacgccgcgcgtctcgcgaagggtctggccggcctgccggggctctcggttgaggcctccgggaccaacatcgttttcgtcgaggtggaccgcgcgatcgcggaggcctttgcgggccatctcgctgcggccagcgtcggggtcactggaaccacccgccaacgctgggtcactcacctcgatgtcggccccgccgacgtcgacgcggcgctggttgcggcccaggccttcttcacggctgcccgtcaggccgccgagtag

SEQ ID NO: 194 - protein, 344 aa, Unknown
  ltaE_5 sequence from unknown bacterial species from environmental sample
MSPIRHDFRSDTVTRPSPAMREAMGRAEVGDDVFGGDPTVNALEAETAELLGKEAGLFLPSGTQSNLVALMAHCGRGDEYITGQQAHCYRWEAGGAAVLGSIQPQPIANAADGTLPLAEIEAAIKPDDPHYATTRLLALENTIGGKVLPQDYVIAATALARKHRLACHLDGARLCNAAVAQNTSAAELAAPFDTVSLCLSKGLGAPVGSVLVGPRDLIGKARRIRKMVGGGMRQAGVIAAGALYALRHNIARLADDHANAARLAKGLAGLPGLSVEASGTNIVFVEVDRAIAEAFAGHLAAASVGVTGTTRQRWVTHLDVGPADVDAALVAAQAFFTAARQAAE

SEQ ID NO: 195 - DNA, 1032 bp, Unknown
  ltaE_6 sequence from unknown bacterial species from environmental sample
atgactgaacgctggatcgacctgcgcagcgacaccgtcacccatccgaatgacgccatgcgcgccgtcatgggctccgccagcgttggcgacgacgtctacgccgacgatcccagcgtgaaccggctgcaggcgacggccgctgagatattcggcttcgaggccggcctgttcgcgccgtccggcacgcagaccaacctgatcgcgctgatgacccattgcgggcgcggcgacgaatacctggtcgggcaggaagcccacacctacaagtacgaaggcggcggcgcggctgttctgggcagcatccagccgcagccgattgtcaaccaggcggacggctcgattgccctagctgacatcgccgccgccatcaagcccgacgacatgcacttcgcgcgcacgcgactgctggcgctggagaacaccattggcgggcgcgtgctgggccgggactacctgcttgcggccaccggcctggcgcacgagcggggacttgccacccacctggacggggcgcgtatctgcaacgccgccgtccagcagggcatcagcctgatggacgcggccacgggtttcgacagcgtgtcggtctgcctgtccaagggcctgggggcgccggtgggctcggtgctgctcgggccgcgcggcttcatcgaggccggcaagcgctggcgcaagatgctgggcggcggcatgcgccaggccggcatcctggcagcggccggcctgtacgcgctggagcacaacgtcgagcgcctggccgaggaccacgccaacgcggccgcgctggccgacggactgcgggtcatcgaacagctgaaggtcagcacgccgcagaccaacatcttctatgtcgagattccggcggatgcctgcgatggcttgcgcgaagcgttggcgcgcgcacacatccgcgccagtatcggtccgcacacgcgcttggtcacgcatctcgacgtcaaggccgaggacgtgaagacggttgtcgacgcattcacccgctttttcgccggctggggggcatccgcatga

SEQ ID NO: 196 - protein, 343 aa, Unknown
  ltaE_6 sequence from unknown bacterial species from environmental sample
MTERWIDLRSDTVTHPNDAMRAVMGSASVGDDVYADDPSVNRLQATAAEIFGFEAGLFAPSGTQTNLIALMTHCGRGDEYLVGQEAHTYKYEGGGAAVLGSIQPQPIVNQADGSIALADIAAAIKPDDMHFARTRLLALENTIGGRVLGRDYLLAATGLAHERGLATHLDGARICNAAVQQGISLMDAATGFDSVSVCLSKGLGAPVGSVLLGPRGFIEAGKRWRKMLGGGMRQAGILAAAGLYALEHNVERLAEDHANAAALADGLRVIEQLKVSTPQTNIFYVEIPADACDGLREALARAHIRASIGPHTRLVTHLDVKAEDVKTVVDAFTRFFAGWGASA

SEQ ID NO: 197 - DNA, 1494 bp, Unknown
  ltaE_7 sequence from unknown bacterial species from environmental sample
gtatacaagcgagagctgaactggctgccatttttcggatggggaattgcatcggcgcagatgattagcatcgatcgcagcaaaggtcaggacgcgttcgaacaagtcgtcgagcagggcaacgatcggttggcacgcggctggtggatcgtaatttttcccgaaggtacgcgcatgcggcccggcacgatgaagcggtacaagaccggtggtgcacgtttggcagtgcgaaccggcgctgttgtcgtaccgattgcactgaactcgggcgagtattggccgaagcattcgttaatcaagacgcccggcatcattacggtgtccatcggtcaaccgatcgatcctcgcgacaagacggctgaagaaatcagtgcgcaagtcgaatcatggatcgaatcagaaatgcggcggctggcgccgcatcgttacagcgctccatacactccggagccccgggtccaaaccgtggccgcgcaaagccttcgcacaccgattgctatgacaattgtcgatttacgctccgatacagtcacacgtccatcgcccggtatgcgcaaagcgatgatggacgcagaagtgggcgatgatgtgttcggcgacgatcccaccgtcaaccggttgcaggcgcgtgccgccgagatattcggcttcgaatcggcactgctttttccgtcaggcacgcaatctaacctcgcagcgctgatgagccattgccagcgcggcgatgaggtaatcgtcggcaagctggcacacacttatcgtaacgaagccggaggcgcagccgtgctcggctcgatccaaccgcacgtcatcacgaatcgcgcggacggctcacttgatctcgctgaagtcgaggcggcgatcaagcccgatgacccgcatttcgctcgaacccgactgcttgcgctcgaaaatacgatctcaggcaaagtactgtcgaggtcttatctcgaaaaggcgttgcagttggcggaggcaaagaaactttctgcacacctcgatggcgcgcgcatcttcaatgcggcggtcgatcagaagatcaaagtgaacgagctgtgcgcgggcttcgactccgtatcggcgtgtctatcgaagggactcggcgctcccgccggaactgtattgctcggaagcaaggatttgatcgagcgcgcgaagcgcaaccgaaagatcctcggtggcgcgatgcgccaggcgggaatcatcgctgcggccggcctttacgcactgcagaacaacatcgagcggttgcaaagcgatcatgacaatgccaagcggctggctgacggattgagagcgttgaagctcgacgtcgaacaacatacgaacatggtattcgtaaacgtgtcagccgaacatgccgctgcgctcgctgcacaccttggacgaagcggcgtgatcgtactgccgtgggcgccaatgcgtttggtcacgcacctcgacgtcgaccgcgacggcatcgagcgagcgctcgatgccgtcgcggaattcgtt

SEQ ID NO: 198 - protein, 498 aa, Unknown
  ltaE_7 sequence from unknown bacterial species from environmental sample
VYKRELNWLPFFGWGIASAQMISIDRSKGQDAFEQVVEQGNDRLARGWWIVIFPEGTRMRPGTMKRYKTGGARLAVRTGAVVVPIALNSGEYWPKHSLIKTPGIITVSIGQPIDPRDKTAEEISAQVESWIESEMRRLAPHRYSAPYTPEPRVQTVAAQSLRTPIAMTIVDLRSDTVTRPSPGMRKAMMDAEVGDDVFGDDPTVNRLQARAAEIFGFESALLFPSGTQSNLAALMSHCQRGDEVIVGKLAHTYRNEAGGAAVLGSIQPHVITNRADGSLDLAEVEAAIKPDDPHFARTRLLALENTISGKVLSRSYLEKALQLAEAKKLSAHLDGARIFNAAVDQKIKVNELCAGFDSVSACLSKGLGAPAGTVLLGSKDLIERAKRNRKILGGAMRQAGIIAAAGLYALQNNIERLQSDHDNAKRLADGLRALKLDVEQHTNMVFVNVSAEHAAALAAHLGRSGVIVLPWAPMRLVTHLDVDRDGIERALDAVAEFV

SEQ ID NO: 199 - DNA, 1002 bp, Unknown
  ltaE_8 sequence from unknown bacterial species from environmental sample
atgatcgatctgcgcagcgataccgtcacccggccgacgcccggcatgctcaaggccatggccgaggcgccggtgggcgatgacgtcttcggtgacgatccgaccgtcaacaaattgcaggcggtggtcgcggagcgcgcgggcaaggaagccgcgctgttcctggcgacaggcacccagagcaatctcaccgccctgatggcccattgcgagcggggcgacgaatatatcgtcggacagaacgcgcatacctataagtacgaaggtggcggcgcggcggtgctgggtagcatccagccgcagccgctggccaacgcgcccgatggcaccattccgctcgacctcatcgccgcggcgatcaagccggacgacacccattttgcgatcacgcgcctgctcgcgctcgaaaacacgatcggaggaaaggtgctgccggcgagttacatcgccgaggccaccgctttcgcgcggagcaagggactcggcacccatctcgacggcgcgcggatctggaacgtgatggcggcgtcgaacgcctcgctcgccgagctctgcgcgcctttcgatacggtctcgatgtgtttctcgaaaggcatgggcgctccggtgggctctgtgctggccggaccgaaggcgctgatcacccgcgcggcgcgctggcgtaaaaccttgggcggcgggatgcgccaggcgggtgtgctggcggcggcctgcctctacgcgctggagaatcacatcggccgcctgcggaccgatcacggaaacgccgccaagctcggcgcggcgctcgggcaaatcccggcgctgaaactcattcatcagtcgacgaatatggtgtggcttaccgtgccgccggagaagtgcgccgcgctcgacagctttctcaaggcgcgcggcatcctgacgctgatggggccaacgctgcgtcttgtcacgcacggcgacctgaagcccggcgacgtcgataccgccatccaggccttcaaggatttcttcaagtag

SEQ ID NO: 200 - protein, 333 aa, Unknown
  ltaE_8 sequence from unknown bacterial species from environmental sample
MIDLRSDTVTRPTPGMLKAMAEAPVGDDVFGDDPTVNKLQAVVAERAGKEAALFLATGTQSNLTALMAHCERGDEYIVGQNAHTYKYEGGGAAVLGSIQPQPLANAPDGTIPLDLIAAAIKPDDTHFAITRLLALENTIGGKVLPASYIAEATAFARSKGLGTHLDGARIWNVMAASNASLAELCAPFDTVSMCFSKGMGAPVGSVLAGPKALITRAARWRKTLGGGMRQAGVLAAACLYALENHIGRLRTDHGNAAKLGAALGQIPALKLIHQSTNMVWLTVPPEKCAALDSFLKARGILTLMGPTLRLVTHGDLKPGDVDTAIQAFKDFFK

SEQ ID NO: 201 - DNA, 1044 bp, Unknown
  ltaE_9 sequence from unknown bacterial species from environmental sample
atgaactcgaccattgacttgcgcagcgacaccgtgacgcgccccaccgctgcgatgcgtgccgcgatgatggaagcgccgctcggcgacgacgtgttcggcgacgatcccacggtcaatgcgctgcaagacaagatcgccggcatgctcggcaaggaggcggcgctgttcatggcgtcgggcacgcagagcaatctgtcggcgttgatggcgcattgccagcgcggcgacgagtacatcgtgggtcagggcgcgcacacctatcgctacgaggccggcggcggcgcggtgctcggcagcatccagccgcagcccatcacgaatcagcccgatggctcgctggcgctggccgacatcgaggccgcgatcaagcccgacgatgcgcatttcgcgcgcacgcgcttgctgtgcctggagaacacgttcggtggccaggtgctcggcatcgactacctgcgccaggccaccgatctggcgcggcgccacggcctggccacgcatctggacggcgcgcgcctgttcaacgccgcggtcgcgctggcgcatcagcagtcgggcggcggcgatgcgcgcgccaaggccaaagagatggccgaactgttcgacagcgtgtcggtgtgcttcagcaagggcctcggcgcgccggtgggttcggcgctggtcggcagccgcgagctgatcgcacgcgcgcaccgcgtgcgcaagatgctgggcggcggattgcgccaggccggcgtgctggccgccgctgcgctgcatgcgctcgaccatcacatcgatcggcttgccgaggatcacgcgaacgcgcagcggctggccgaagggctgcgcgggcttggcagtgtgttgaacgcgccggccaacaccaacatggtcttcgtcgacctggcacccggcggctcacgccaggacaccgtggcccacctgcgcgagcacggcgtgttgtgcaccggcttgtacaagctgcgcctggtgacgcacctcgacgtgagtgccgacgacgtcgatcgcgccgtgcgcatcttgcgcgagacgttgaacacg

SEQ ID NO: 202 - protein, 348 aa, Unknown
  ltaE_9 sequence from unknown bacterial species from environmental sample
MNSTIDLRSDTVTRPTAAMRAAMMEAPLGDDVFGDDPTVNALQDKIAGMLGKEAALFMASGTQSNLSALMAHCQRGDEYIVGQGAHTYRYEAGGGAVLGSIQPQPITNQPDGSLALADIEAAIKPDDAHFARTRLLCLENTFGGQVLGIDYLRQATDLARRHGLATHLDGARLFNAAVALAHQQSGGGDARAKAKEMAELFDSVSVCFSKGLGAPVGSALVGSRELIARAHRVRKMLGGGLRQAGVLAAAALHALDHHIDRLAEDHANAQRLAEGLRGLGSVLNAPANTNMVFVDLAPGGSRQDTVAHLREHGVLCTGLYKLRLVTHLDVSADDVDRAVRILRETLNT

SEQ ID NO: 203 - DNA, 1098 bp, Unknown
  ltaE_10 sequence from unknown bacterial species from environmental sample
atgcggcacgagccggccgggaagctgcccctcgcctcgacctgctccaacgaatcaccaatcacgaatcacgaatcacggctctccatgctgatcgacctcagaagcgacaccgtcacccgtcccaccgcggcgatgcgcgaggcgatgctgcgcgcggaggtcggtgacgacgtctacggcgaggacccgaccgtgaacgcgctgcaggcgcggctggcggccgagctcggcttcgaggccggcctgttcgtgccctcgggcacgcagtcgaacctgctggcgctgatgagccattgcgcgcgcggcgacgagtacctggtcgggatggaggcgcacacctacaagttcgaaggcggcggcgccgcggtgctgggctcgatccagccgcagccgatcccgcacgcgcccgacggcacgctgccgctcgatgccgtggcgcgcgcgatcaagccggtcgatccgcacttcgcccgcagccgtctgctgtgcctggagaacacctggcacggccgaccgctgccgctcgactacctcgcgcaggcgcgtgccttctgtcgcgagcgcgggctcggcctgcacctggatggcgcgcgcctgttcaatgccgcggtcgcctgccgggtcgaggcacgcgccatcgcccggcacttcgacagcgtctcgatctgcttctccaagggcctgggcgcaccggtcggctcggtactggtcggctcgcacgcgctgatcgacgaggcgcggcgctggcgcaaggtcgccggcggcggctggcgccaggccggcatgctggcggcagcctgcctgtacgcgctcgaccatcacgtcgcgcgactggccgacgaccatgcccgcgccgcgcgcctggccgaaggtctgcgcggcctgactgggctcgaggtcgtggcgcagcacaccaacatggtgttcatcgacgtcgcaccggaacggctggcggcgttcaagcagcaactcgaggcggcgcgcatccggatgtcgatcggctacctgccgagcatccgtctggtgacgcacctggacatcgacgacgccgcggtcgagcacacgatcgcgacgctgcgtgggttcttccgctga

SEQ ID NO: 204 - protein, 365 aa, Unknown
  ltaE_10 sequence from unknown bacterial species from environmental sample
MRHEPAGKLPLASTCSNESPITNHESRLSMLIDLRSDTVTRPTAAMREAMLRAEVGDDVYGEDPTVNALQARLAAELGFEAGLFVPSGTQSNLLALMSHCARGDEYLVGMEAHTYKFEGGGAAVLGSIQPQPIPHAPDGTLPLDAVARAIKPVDPHFARSRLLCLENTWHGRPLPLDYLAQARAFCRERGLGLHLDGARLFNAAVACRVEARAIARHFDSVSICFSKGLGAPVGSVLVGSHALIDEARRWRKVAGGGWRQAGMLAAACLYALDHHVARLADDHARAARLAEGLRGLTGLEVVAQHTNMVFIDVAPERLAAFKQQLEAARIRMSIGYLPSIRLVTHLDIDDAAVEHTIATLRGFFR

SEQ ID NO: 205 - DNA, 1002 bp, Unknown
  ltaE_11 sequence from unknown bacterial species from environmental sample
atgacggttgacctgcgctccgataccgtcacgcgcccttcggcggggatgcgcaaggcgatgatggaggccgagctgggcgacgacgtgttcggcgacgacccgaccgtcaaccgcctgcaggagcgggcggccgagatcttcggcttcgaggccgccctgcttttccccaccggcacccagtcgaatctcgccgccctgatcgctcactgcgatcggggcgacgaagtcatcctcggctcggaagcccacagttaccgctacgaggccggcggcctcgcggtgctcggctcgatccagccgcaggtggttcccaaccgtgccgatggaacccttgatttgaatgaagtggaatccctgataaagcccgacgaccctcacttcccgcgcacgcggctgctcgcgctcgagaacacgattaccggccgggtcatcccgcggccgtatctcgagcaggcggttgccctcgcgaaaaagaagcggctcgccgtccacctggacggggcgaggattttcaatgccgcaacggcgctgaagatgaaggtgaaagacctgtgcgccgggttcgactcggtgtcgtcgtgcctgtcgaaagggctgggcaccccggccggcaccgttcttctcggcggaaaagaattcatccagaaagcgaaacgcgcgcggaaaatcctcggcggcgggatgcggcaggcgggcgtgatcgccgcggccgggctctacgcgctggagaacaacgtcgagcgcctgcgcatcgatcacgacaacgcggaaaagcttgcacgcggcttacgcgacttgaaactggacgttcagctaaataccaacatggtgctggtgaagatcaagccggaggaagcccacgatctggcttcgtttatgagcaccaagggtgtgctcgtgctgccgcgtgcgccgatgcggctggtcacccacctcgacgtcgacgccgccgggatcgaccgcgcgctcgtaggcttccgcggctttttcggaaaatga

SEQ ID NO: 206 - protein, 333 aa, Unknown
  ltaE_11 sequence from unknown bacterial species from environmental sample
MTVDLRSDTVTRPSAGMRKAMMEAELGDDVFGDDPTVNRLQERAAEIFGFEAALLFPTGTQSNLAALIAHCDRGDEVILGSEAHSYRYEAGGLAVLGSIQPQVVPNRADGTLDLNEVESLIKPDDPHFPRTRLLALENTITGRVIPRPYLEQAVALAKKKRLAVHLDGARIFNAATALKMKVKDLCAGFDSVSSCLSKGLGTPAGTVLLGGKEFIQKAKRARKILGGGMRQAGVIAAAGLYALENNVERLRIDHDNAEKLARGLRDLKLDVQLNTNMVLVKIKPEEAHDLASFMSTKGVLVLPRAPMRLVTHLDVDAAGIDRALVGFRGFFGK

SEQ ID NO: 207 - DNA, 969 bp, Unknown
  ltaE_12 sequence from unknown bacterial species from environmental sample
atggcggccgagctcggcgacgacgtgttcggcgacgacccgaccgtcaaccgcctgcaggagcgcgccgccgaggtcttcggcttcgaggcggcgctgctctttccctccgggacccagtcgaacctcgcggcgctgatgggacactgccagcgcggcgaggaggtgatcctcgggacggaagcgcatagctaccgctacgaggcgggcgggctctcggtgctcggctcgatccacccgcaggcgatcaccaaccgggcggacggcacgctggatctcgccgaggtcgaggccgcgatcaagcccgacgacccgcattttccgaggactcgcctcattgctctggagaacacgatcaccggccgggtcctgccccgcgaatacctggccaaggcggcggagctggcgaagcggaaaaacctggcgatccacctcgacggcgcgcgggtgttcaacgcggcgacgcatctcggcatgaaggtgaaagacctttgcgccggcttcgactcggtgtcctcgtgcctgtcgaaggggttgggcacgccggcaggcacggtgctcctcggcagcaagtccttcatcgggaaagcaagacgctcgcgcaagatcctcggcggcgcgatgcgccaggcgggggtcatcgctgccgcgggactctacgcgctcgagcacaacgtcgagcgcctgaagaccgatcacgagaatgccgagcgccttgccaggggattgcgcgagctcgggctcgaagtgcagcacaacacgaacatggtgctggtgaagattgcgccggaccgggcagcggcggtggaagtccacatgaggaagaacaacatcctggtcctgccgcgcgcgccgatgcggctcgtcacgcatctcgacgtcgacgcggccggcatcgaccgcgcgctcgccgggtttcgcagcttcctagggagtggtttcctcgaaagccaggcgcagtcgcgctag

SEQ ID NO: 208 - protein, 322 aa, Unknown
  ltaE_12 sequence from unknown bacterial species from environmental sample
MAAELGDDVFGDDPTVNRLQERAAEVFGFEAALLFPSGTQSNLAALMGHCQRGEEVILGTEAHSYRYEAGGLSVLGSIHPQAITNRADGTLDLAEVEAAIKPDDPHFPRTRLIALENTITGRVLPREYLAKAAELAKRKNLAIHLDGARVFNAATHLGMKVKDLCAGFDSVSSCLSKGLGTPAGTVLLGSKSFIGKARRSRKILGGAMRQAGVIAAAGLYALEHNVERLKTDHENAERLARGLRELGLEVQHNTNMVLVKIAPDRAAAVEVHMRKNNILVLPRAPMRLVTHLDVDAAGIDRALAGFRSFLGSGFLESQAQSR

SEQ ID NO: 209 - DNA, 1017 bp, Unknown
  ltaE_13 sequence from unknown bacterial species from environmental sample
atgatcgatcttcgttccgacaccgtaacccgcccctcgcccgggatgcgcaaggcgatgcacgaagccgagctcggcgacgacgtgttcggcgacgacccgaccgtcaaccgcctgcaggcgcgcgccgccgagatgttcggcttcgaggcggcgctgctctttcccaccggcacccagtccaacctcgcggcgctgatgagccactgcggccgcggcgaggaagtgatcctcggcatggaggcgcacagctaccgctacgaggcgggcggcgtctcggtgctcgcttccatccagccgcaggcagtgccgaaccgccccgacggctcgctcgatctggcggaagtcgaggccgcgatcaagcccgacgacccgcatttcgcgcgcacgcgtctgctggcgctcgagaacaccatcagcggccgggttctatcccgcgaatatctgcaaaaggcggtggatctggcgaggcgcaaacacctcgcgatccacctcgacggcgcgcggattttcaatgcggccacccagctcaacatgaaggtgaaggacctttgcgccggcttcgactcggtttcctcctgcctgtccaagggattgggcacgcctgcgggtacggttctgctgggaagctcggaattgatccagaaggcaaagcgcgcgcgcaagatcctcggcggcggaatgcgccaggcaggcgtgattgcggccgcgggcctctacgcgctggagaacaacgtcgagcgtctgaagacggaccatgaaaatgccgagcggctggcgcgtgggctgcgcgagctcggactggacgttcagcacaacaccaacatggtgatggtgaagcttccgccggagaaggcccagccgctggccgatgcgttgaaacggcagcacatcctggtgctgccgcgcgcgccgatgcgcctcgtcacgcacctggatgtcgacgcggcgggcatcgaccgcgcgctggcgggcttccgcagcttctttggcgcccgggctccgtccccgaactga

SEQ ID NO: 210 - protein, 338 aa, Unknown
  ltaE_13 sequence from unknown bacterial species from environmental sample
MIDLRSDTVTRPSPGMRKAMHEAELGDDVFGDDPTVNRLQARAAEMFGFEAALLFPTGTQSNLAALMSHCGRGEEVILGMEAHSYRYEAGGVSVLASIQPQAVPNRPDGSLDLAEVEAAIKPDDPHFARTRLLALENTISGRVLSREYLQKAVDLARRKHLAIHLDGARIFNAATQLNMKVKDLCAGFDSVSSCLSKGLGTPAGTVLLGSSELIQKAKRARKILGGGMRQAGVIAAAGLYALENNVERLKTDHENAERLARGLRELGLDVQHNTNMVMVKLPPEKAQPLADALKRQHILVLPRAPMRLVTHLDVDAAGIDRALAGFRSFFGARAPSPN

SEQ ID NO: 211 - DNA, 1002 bp, Unknown
  ltaE_14 sequence from unknown bacterial species from environmental sample
atgaatcaacccatagaccttcgctccgatacggttacccgtccttcagccggcatgcgcaaggccatggcggaggccgagctcggcgacgacgtcttcggcgacgaccccaccgtcaaccgcctgcaggcgcgcgccgccgagctgttcggggtggaggcggcgcttttcttccccagcggcacgcagtccaacctcgccgcgctgatgtcgcattgccagcggggcgaggaagtcatcctcggctccgaggcgcacagctatcgctacgaggccggcgggctcgccgtcctcggctcgatccagccgcaggtcgtgctcaaccgcgccgatggcacgctcgatctcgcggaagtggaagcggcgatcaagcccgacgatccgcatttcccgaaaacgcgattgctcgcgctcgagaacacgataacggggcgggtgctcccccgctcctacctcgaaaaggcgatcaacgttgcaaacaggcgcggtctcgccacccacctcgatggcgcgcgcatcttcaacgcggcaatgcacgagaagatcaacgtcaaaacgctgtgcgcaggattcgattcggtctcgtcgtgcctgtccaaagggctcggcacgccggccggcaccgtgctggtcgggaaaaaagagatcatcgagaaggccaagcgcgcaagaaagatcctgggcgggggcatgcgccaggccggggtgctggccgcagccggcctctacgcgctggagaacaacgtcgagcggctcgccgaagaccacgccaacgccgagcggctcgccaaagggctgcgcgagctgggacaggaagtgcagctcagcacgaacatggtgatgctcactatcccgtccgagaaggccgcgccgctcgccgagcacatgaagaagagcggcgtgatcgtgctgccgcgggcaccgatgcggcttgtcacgcacctcgacgtcgacgcggccggcatcgatcgcgcgctggccgccttccgcgctttcttctag

SEQ ID NO: 212 - protein, 333 aa, Unknown
  ltaE_14 sequence from unknown bacterial species from environmental sample
MNQPIDLRSDTVTRPSAGMRKAMAEAELGDDVFGDDPTVNRLQARAAELFGVEAALFFPSGTQSNLAALMSHCQRGEEVILGSEAHSYRYEAGGLAVLGSIQPQVVLNRADGTLDLAEVEAAIKPDDPHFPKTRLLALENTITGRVLPRSYLEKAINVANRRGLATHLDGARIFNAAMHEKINVKTLCAGFDSVSSCLSKGLGTPAGTVLVGKKEIIEKAKRARKILGGGMRQAGVLAAAGLYALENNVERLAEDHANAERLAKGLRELGQEVQLSTNMVMLTIPSEKAAPLAEHMKKSGVIVLPRAPMRLVTHLDVDAAGIDRALAAFRAFF

SEQ ID NO: 213 - DNA, 1005 bp, Unknown
  ltaE_15 sequence from unknown bacterial species from environmental sample
atggcctcaatcgtagacctgcgctcggataccgtcacgcgtccctccgcggcgatgcgccgcgcgatgctggagtcggagcttggcgacgacgtgttcggcgacgacccgacggtcaatcgcctgcaggagcgggccgcggagatcttcggcttcgaagccgccttgctgtttccgtccggtacgcagtccaacctcgccgccctcatgagccattgccagcgtggcgaggaagtgattctcggccaggaggcgcacagctatcgctacgaggcgggcggcgctgcggtactgggctcgatccagccccaggcgatcgccaaccggcccgacggcacgctcgatctcgccgaagtcgaggccgcgatcaagcccgacgatccgcacttcgcaagaacgcgcctgctcgcgctcgagaacacgatcggcggtcgggtgctcccccgccgctatctcgccgaagcgctcgatctcgcgaagaagaagactcttgcgacgcacctcgatggcgcacgcgtcttcaacgccgcgaccgagctgcagatgaaggtgaaggacctgtgcgcgggattcgactcggtgtcggcctgcctgtcgaagggcctgggcgcgcccgcgggaaccgtgctgctcggcaggaaggatttcatccagaaagcgaagaggtcgcgcaagatcctcggcggcgcgatgcgccaggccggggtgatcgccgccgccggcctctacgcgctcgaaaacaacgtcgcgcgcctggaggaggaccatcgcaatgcgcagcggctggcgaaggggctgcaggggctggagcttccggccgagcagcacaccaacatggtcttcgtgcgcatcgcacccgagcggctggagggcctggccggccatctgaagaaggcaggcatcgcggtgctgccgggcgcgcgcatgcggctggtgacgcatctcgatgtggacgccgccggggtcgagcgcgcgctggcggcgttccggagctacttccggtaa

SEQ ID NO: 214 - protein, 334 aa, Unknown
  ltaE_15 sequence from unknown bacterial species from environmental sample
MASIVDLRSDTVTRPSAAMRRAMLESELGDDVFGDDPTVNRLQERAAEIFGFEAALLFPSGTQSNLAALMSHCQRGEEVILGQEAHSYRYEAGGAAVLGSIQPQAIANRPDGTLDLAEVEAAIKPDDPHFARTRLLALENTIGGRVLPRRYLAEALDLAKKKTLATHLDGARVFNAATELQMKVKDLCAGFDSVSACLSKGLGAPAGTVLLGRKDFIQKAKRSRKILGGAMRQAGVIAAAGLYALENNVARLEEDHRNAQRLAKGLQGLELPAEQHTNMVFVRIAPERLEGLAGHLKKAGIAVLPGARMRLVTHLDVDAAGVERALAAFRSYFR

SEQ ID NO: 215 - DNA, 957 bp, Unknown
  ltaE_16 sequence from unknown bacterial species from environmental sample
atgcgccgcgcgatgttcgacgccgaggtcggcgacgatgtttggggtgacgatccgaccgtgaaccgcttgcaggagcggtcggcggaaatcttcgggttcgaggctgccctgttctttccttccggaacgcagtcgaacctggcggcgttgatgtgccattgtcagcgcggcgacgaggtgatcgttggtgcggaggcgcacacctaccgctacgaggcaggcggaatctcggtgctcgcctcggtccatccgcgtccactcccgaatcagccggacggaaccctcgacctcgccgaagtcgaacgcgcgatcaaccctgaggatgcacatttcgcgaggacacgcctcctcacgctggagaataccataagcggacgcgttctcccgagcacctatctcgagtccgcgatgtcgcttgcccagcgaaaccatttatcgacgcatctggatggcgcgcggatcttcaatgcagcgcttcacctaggcgtggcggtcagagagctttgttacggattcgattcggtctctgcctgcctgtctaagggactgggggctcctgccgggacgatcctgctgggaagcaaagctttcatcgaggaggccaaacgcgcgcgtaagctcctggggggaggcatgcggcaagtcggaattctcgcggctgctgggctctatgcgctcgagaacaacgtcgagcgaatggctgacgatcatcggaacgccgtacgtctcgccgaaggattgcgagagctaggactcgcagtaggacaaagtacgaatatggttttcgttactattccggatggtcaagcgcgcggtctggccgaagccctgaaaaatgcccaggtcctcgtggcccctgaagagacgatgaggttggtaacccacctcgacgtggatgcagcggggatcgagcgggtgatagaaggcttccgtgctttcttccggtccaattaa

SEQ ID NO: 216 - protein, 318 aa, Unknown
  ltaE_16 sequence from unknown bacterial species from environmental sample
MRRAMFDAEVGDDVWGDDPTVNRLQERSAEIFGFEAALFFPSGTQSNLAALMCHCQRGDEVIVGAEAHTYRYEAGGISVLASVHPRPLPNQPDGTLDLAEVERAINPEDAHFARTRLLTLENTISGRVLPSTYLESAMSLAQRNHLSTHLDGARIFNAALHLGVAVRELCYGFDSVSACLSKGLGAPAGTILLGSKAFIEEAKRARKLLGGGMRQVGILAAAGLYALENNVERMADDHRNAVRLAEGLRELGLAVGQSTNMVFVTIPDGQARGLAEALKNAQVLVAPEETMRLVTHLDVDAAGIERVIEGFRAFFRSN

SEQ ID NO: 217 - DNA, 1014 bp, Unknown
  ltaE_17
atgacgatcgtcgacttacgttccgataccgtcacgcgtccgtcaccgggcatgcgcaaagcgatgatggacgccgaagttggcgatgatgtgttcggcgacgatccgacggtcaatcgactgcaagcgcgcgcggcggagatcttcggcttcgagtcggcgctgctgtttccatcgggcacgcagtccaatctggcggcgctgatgagtcattgtcagcgtggcgatgaggtaatcgtcggccagctggcgcacagttaccgtaacgaagccggcggcgcggccgtgctcggctcgattcagccgcaagccattacgaatcgcgctgacggctcacttgatctcgctgaaatagaggcggctatcaagcctgacgacccgcatttcgcgcggacccgtctgcttgcgctcgagaacacgatctcaggcaaggtgctaacgaggtcgtatcttgagaaggctttgcaattggctaaggcaaagaagctgtttacgcatctcgatggcgcgcgcattttcaatgccgccgccgatcagaagatgaaagtgaacgagctgtgcgcgggcttcgattccgtatcggcgtgtttatcgaaggggctaggcgctcccgccggaacagtattgctcggaagcaaggatctgatcgagcgagcgaagcgcaaccgaaaaatcctcggcggcgcgatgcgccaggcggggattatcgctgccgcgggtctttacgcactacagaacaacatcgagcggttgcaaagcgatcatgacaatgccgagcggctggccgccggattaagaatgctgaagctcgacgtcgaacaacatacgaacatggtgttcgtgaacatgccagccgaacatactgctgcgctcgctgcgcatcttgggcgacgtggcgtggtcgtgatgccgtgggcgccgatgcgtttggttacgcacctcgacgtcgaccgcgccgggatcgagcgagtgctcggtgcggtcgctgagttcgtttccgttaattcggtgtaa

SEQ ID NO: 218 - protein, 337 aa, Unknown
  ltaE_17 sequence from unknown bacterial species from environmental sample
MTIVDLRSDTVTRPSPGMRKAMMDAEVGDDVFGDDPTVNRLQARAAEIFGFESALLFPSGTQSNLAALMSHCQRGDEVIVGQLAHSYRNEAGGAAVLGSIQPQAITNRADGSLDLAEIEAAIKPDDPHFARTRLLALENTISGKVLTRSYLEKALQLAKAKKLFTHLDGARIFNAAADQKMKVNELCAGFDSVSACLSKGLGAPAGTVLLGSKDLIERAKRNRKILGGAMRQAGIIAAAGLYALQNNIERLQSDHDNAERLAAGLRMLKLDVEQHTNMVFVNMPAEHTAALAAHLGRRGVVVMPWAPMRLVTHLDVDRAGIERVLGAVAEFVSVNSV

SEQ ID NO: 219 - DNA, 1005 bp, Unknown
  ltaE_18 sequence from unknown bacterial species from environmental sample
atgccagggcttgtcgacctgcgttccgacaccgtcacacggccttcccccggcatgcgccgcgcgatgctcgaggccgagctcggcgacgacgtgttcggcgacgatccgacggtcaaccgcctgcaggcgcgcgccgccgagatcttcggcatggaagcgggcctgctcctgccctcgggcacccagtccaacctggcggcgctgatgagccattgccagcgcggcgacgaggtgatcatcggccaggaggcgcacagctaccgctacgaagccggcggcatggcggtgctcggctcgatccagccgcgcaccgtggccaaccgtgccgacggcagcctcgacctccgcgaggtcgaggcggcgatcaacccggacgacgcgcatttcgcgaggacccggctgctcgccctcgagaacacgatctcgggccgcgtgctttccgggaagtatttacgcgaagcggtcgatcttgcaaatcgaaaaaagctggcgacccacctggacggtgcgcgcatcttcaacgcggcggtccacgaaggcaccggcgtgaaggagctgtgcgccggcttcgactcggtatcggcgtgcctgtcgaaggggctgggcgctccggccgggacggtcctggtgggcaggaaagagctcatcgacaaggcgcggcgcgcgcgcaagatgctcggcggcgcgatgcggcaggcgggcgtgatcgcggcggccgggctgtatgcgctcgagcacaacgtcgagcggctcgccgaggaccacgccaacgccgtcaggctgtcgaaaggactggcggagatcggcctgcccgtcgagcagcacaccaacatggtgtttgcacggattccgcccgagcgtgtcgcgccactggaatcccatctgaaggatagaggcgttctggtgctgcccggcgcgcgcatgcgtctcgtcacgcacctcgacctcgaccgcgagggcgtcgagcgcgcgctcgcggcgttcagggggttcttcggctga

SEQ ID NO: 220 - protein, 334 aa, Unknown
  ltaE_18 sequence from unknown bacterial species from environmental sample
MPGLVDLRSDTVTRPSPGMRRAMLEAELGDDVFGDDPTVNRLQARAAEIFGMEAGLLLPSGTQSNLAALMSHCQRGDEVIIGQEAHSYRYEAGGMAVLGSIQPRTVANRADGSLDLREVEAAINPDDAHFARTRLLALENTISGRVLSGKYLREAVDLANRKKLATHLDGARIFNAAVHEGTGVKELCAGFDSVSACLSKGLGAPAGTVLVGRKELIDKARRARKMLGGAMRQAGVIAAAGLYALEHNVERLAEDHANAVRLSKGLAEIGLPVEQHTNMVFARIPPERVAPLESHLKDRGVLVLPGARMRLVTHLDLDREGVERALAAFRGFFG

SEQ ID NO: 221 - DNA, 939 bp, Unknown
  ltaE_19 sequence from unknown bacterial species from environmental sample
atgcttgaagcagagctcggcgacgatgtcttcggcgacgatcccacggtgaaccggctccaggcgagggcggccgagctcttcggtttcgaggcagcgcttttctttccgtccggcacgcaatccaacctcgcggcgctcatgagccactgccagcgcggcgaggaggtgatcctcggtcacgaagcgcacagctatcgctacgaggcgggcggcgccgcggtgctggggtcgatccagttgcaggtggtggccaaccggcccgacggcacgcttgaccttgccgaggtcgaagcggcgatcaagcccgacgatccgcactttgcaaagacacgcctccttgctctcgagaacaccatcggcgggcgcgccttgccgcgcgcgtatctggagcaggcattgaagctcgcgcagcgccggggtctgcaaacccatttggacggcgcgcgagtcttcaacgccgcggtgtatttcggaacgggcgtcaaggcgctttgcgccgggttcgattcggtgtcggcgtgcctctccaaaggattgggcgcaccggcaggaacggttctactgggcagcaaggaactcatcgcaagagcgcggcgggcgcgcaagattctcggtggcgcgatgcgccaggcgggtgtcctcgccgcggccgggctctacgcgctcgagaacaacgtcgagcgcctcgccgaggaccatgagaacgcgcgaggactcgcgagcggcctgcgcgcgctggacctcgcggtcgagcagcacaccaacatggtcttcgtgcgcgttgcgcccgagcacgtggagcggctcgcggcccacctcgcaaatcgcggcgtcgccgtgctgccagcagcacgcatgcggctcgtcacgcacctggacgtcgacagcgctgcggtggagcgcgccgtcggcgcgttcagagcgttcttcgcctag

SEQ ID NO: 222 - protein, 312 aa, Unknown
  ltaE_19 sequence from unknown bacterial species from environmental sample
MLEAELGDDVFGDDPTVNRLQARAAELFGFEAALFFPSGTQSNLAALMSHCQRGEEVILGHEAHSYRYEAGGAAVLGSIQLQVVANRPDGTLDLAEVEAAIKPDDPHFAKTRLLALENTIGGRALPRAYLEQALKLAQRRGLQTHLDGARVFNAAVYFGTGVKALCAGFDSVSACLSKGLGAPAGTVLLGSKELIARARRARKILGGAMRQAGVLAAAGLYALENNVERLAEDHENARGLASGLRALDLAVEQHTNMVFVRVAPEHVERLAAHLANRGVAVLPAARMRLVTHLDVDSAAVERAVGAFRAFFA

SEQ ID NO: 223 - DNA, 942 bp, Unknown
  ltaE_20 sequence from unknown bacterial species from environmental sample
atggcggaggccgaggtcggcgacgatgtgtttggcgacgaccccacggtgaaccggctgcaggcgcgcgcggcggaggtgctcgggttcgaggcggcgctgatcttcccctcgggaacgcagtcgaacctagccgcgctgatgacgcactgtcagcggggcgacgaaatgatcgtcggccaagaggcgcatacctacgtccatgaggcgggcggcacctccgtgctcggtgcgatccatccgcacgttgtccccaacctgcccgacggcacgctcgacctgagcgacgtggaggcggccatcaagcccgacgatccgcactacccgcggacacggctcctcgccctcgagaatacaatcggcggacgggcggtgccgcgcgcgtatctcgagcgcgcggttggtcttgcaaggcgccgccgcctcgccacgcatctcgacggtgcgcggatcttcaacgccgcggtggcgctgaataccgatgtgaggaatctgtgtgcgggattcgactccgtgtccgtgtgtctgtcgaagggattgggcgcaccggtcgggacgctcctcctcggcagcgccgacttcatcgcgcgcgcgacgcgcgtgcggaagatccttgggggtgggatgcgccaggtcggcgtactcgctgcggcaggactgtatgcgctggaacacaactcgagccgcctgcacgtcgaccacgagcacgccgcgcggctggcgcagggcctcgggcggctgggccttccggtcgagcatcacaccaacatggtgttcgtgcgcgtcggtgctgacgcggaggcgctggcggggcatctggagcgtcacggagtcttggtactggcggagccacgtatgcggctcgtcacgcatctcgatgtcgacgcggcggggatcgatcgagcggtcgaggcgtttacggcttttcgctggtcacgataa

SEQ ID NO: 224 - protein, 313 aa, Unknown
  ltaE_20 sequence from unknown bacterial species from environmental sample
MAEAEVGDDVFGDDPTVNRLQARAAEVLGFEAALIFPSGTQSNLAALMTHCQRGDEMIVGQEAHTYVHEAGGTSVLGAIHPHVVPNLPDGTLDLSDVEAAIKPDDPHYPRTRLLALENTIGGRAVPRAYLERAVGLARRRRLATHLDGARIFNAAVALNTDVRNLCAGFDSVSVCLSKGLGAPVGTLLLGSADFIARATRVRKILGGGMRQVGVLAAAGLYALEHNSSRLHVDHEHAARLAQGLGRLGLPVEHHTNMVFVRVGADAEALAGHLERHGVLVLAEPRMRLVTHLDVDAAGIDRAVEAFTAFRWSR

SEQ ID NO: 225 - DNA, 1029 bp, Unknown
  ltaE_21 sequence from unknown bacterial species from environmental sample
gtgagcacgatcgaccttcgcagcgacaccatcacgcggcccggccccgtcatgcgtcgcgccatggccgaggcggaagtgggcgacgacgtcttcggcgacgaccccaccgtcaaccgcctccaggacgcgtgcgccgagcggttcgggatggaggccgggctgctgtttcccaccggcacgcagtccaatctcgccgccctgatgtcccactgcgcccgcggcgaggaggtgatcgtcgggcaggaggcccacacctaccggtacgaggccggcggcatggccgtcctcggctcgatccagccgcagccgctccagaaccggtccgagggcacgctcgacctggccgaggtggaggcggcgatcaagccggacgacccccacttcgcggtgacgaaactggttgccctggagaacacgatcggcggtaaggtcctgcctcgggcctacttggccgacgcggtcgccctggcgcgccgccggggactttcgctgcacctcgacggcgcccgcgtcttcaatgcggcggtgaagctcggcgtgccggtggaccggctgtgcgaggggttcgacacggtgtcggtgtgcctctcgaagggactgggcgcgcccgcggggacagtgctcgtcggccgccgcgacgtcatcgaccgcgcgaagcgcgtgcggaagatgctgggcggcacgatgcgccagtccggcgtcctcgccgccgcgggcctctacgcgctggcgcaccacgtggaccgcctcgccgaagaccacgccaacgcccagcgcctcggccgggcgctcgaagggctggggctgagggtggagccggtgcagacgaacatggtcttcgtccacgtcccccgcgagtccgagacggcgctgcgcgcccacctcgcgtcgcgaggcgtgatgaccctccccggcccgcggctgcggcttgtcacccacctcgacgtcgacgccgccggaatcgaccgcgccgtcgaagccttcgccagtttcttccgggcggcgaatctgaaatctcaaatttga

SEQ ID NO: 226 - protein, 342 aa, Unknown
  ltaE_21 sequence from unknown bacterial species from environmental sample
VSTIDLRSDTITRPGPVMRRAMAEAEVGDDVFGDDPTVNRLQDACAERFGMEAGLLFPTGTQSNLAALMSHCARGEEVIVGQEAHTYRYEAGGMAVLGSIQPQPLQNRSEGTLDLAEVEAAIKPDDPHFAVTKLVALENTIGGKVLPRAYLADAVALARRRGLSLHLDGARVFNAAVKLGVPVDRLCEGFDTVSVCLSKGLGAPAGTVLVGRRDVIDRAKRVRKMLGGTMRQSGVLAAAGLYALAHHVDRLAEDHANAQRLGRALEGLGLRVEPVQTNMVFVHVPRESETALRAHLASRGVMTLPGPRLRLVTHLDVDAAGIDRAVEAFASFFRAANLKSQI

SEQ ID NO: 227 - DNA, 1023 bp, Unknown
  ltaE_22 sequence from unknown bacterial species from environmental sample
atgagcgcgcccgtcgatcttcgctccgataccgtcacgcgcccctcgcccgggatgcgcaaggcgatgctggaagccgagctcggcgacgacgtgttcggcgacgacccgaccgtcaaccgcctccaggcgcgcgccgccgagatcttcggcttcgaggcggcgctgctctttccctccggcacgcaatcgaacctcgccgcgctcatgagccactgccagcgcggcgacgaggtgatcctcggcatggaggcgcacagctaccgctacgaggcgggcggcctctcggtgctcggctcgattcagccgcaggcgattcccaaccgtccggacgggaccctcgacctggccgaggttgaagccgcgatcaagcccgacgacccgcactttgcccgctcccggttgctcgctctggaaaacacgatcaccggccgcgttctcaagcgtgagtacctgggcaaggctgtggagctggcaagacggaagaatctctcgattcacctcgacggggcgcgcgtcttcaacgccgccacagcgctcaccatgaaggtgaaggagctgtgcgccggcttcgactcggtgtcgtcgtgcctctcgaaggggctcggcgcgccggccggcaccgtcctgctgggtaatagggatttcattcaaaaagccaaacgggcaagaaagatcctcggcggcgggatgcggcaggcgggcgtgatcgccgccgcgggcctctacgcgctcgagaacaacgtcgagcggctgcgcgaggaccacgagaacgccgagcgcctcgcgcgcggactgcgcgagctcgggctcgaagcccagctcaacacgaacatggtgctcctgaagattgagccggcaaaagcacaaccactagccgagagacttcttcagtctaagattctcgtattgccgcgcgcgccgatgcggctggtgacgcatcttgacgtcgacaaggcaggaattgatcgcgcgctatcggcgttccgcgcgttcttctcgcaaaacgaattacgaccctga

SEQ ID NO: 228 - protein, 340 aa, Unknown
  ltaE_22 sequence from unknown bacterial species from environmental sample
MSAPVDLRSDTVTRPSPGMRKAMLEAELGDDVFGDDPTVNRLQARAAEIFGFEAALLFPSGTQSNLAALMSHCQRGDEVILGMEAHSYRYEAGGLSVLGSIQPQAIPNRPDGTLDLAEVEAAIKPDDPHFARSRLLALENTITGRVLKREYLGKAVELARRKNLSIHLDGARVFNAATALTMKVKELCAGFDSVSSCLSKGLGAPAGTVLLGNRDFIQKAKRARKILGGGMRQAGVIAAAGLYALENNVERLREDHENAERLARGLRELGLEAQLNTNMVLLKIEPAKAQPLAERLLQSKILVLPRAPMRLVTHLDVDKAGIDRALSAFRAFFSQNELRP

SEQ ID NO: 229 - DNA, 1017 bp, Unknown
  ltaE_23 sequence from unknown bacterial species from environmental sample
atgacggttgacctacgctccgataccgtcacgcgtcctggcactggaatgcgcaaggcgatgatggaagccgagctcggcgacgatgtgttcggcgacgacccgaccgtcaaccgcctgcaggcgcgcgccgccgagatcttcggcttcgaggcggcgctcctctttccctccggcacgcaatcgaacctggccgcgctcatgagccattgccagcgcggcgacgaggtgatcctcggcatggaggcgcatagctaccgctacgaggcgggcggcctctcggtgctcggctcgatccagccgcaggcgattcccaaccgtccggacggcacgctcgatctcgcggaagtggaagcggcgatcaagcccgacgatccgcacttcgcgcgaacacggttgctggcgcttgagaacaccatcaccggccgcgtgctctcgagaagttatctggaacaggccatcgggctggcgaagaaaaaaaacctctcgattcacctcgacggggctcgcgtcttcaacgccgcaagcgcgctcaagatgccggtgaaagacctttgcgccggattcgactcggtgtcgtcgtgtctctcgaagggcctcggtgcgcccgccggcacagtgctcttaggtagtaaacctttcatagaaaaagcaaagcgcgcacgcaagatcctcggcggcggcatgcggcaggcgggcgtgatcgcggcggcggggctttatgcgctcgagcacaacgttgaaagattgaataccgatcatgagaacgcggagcgccttgcgcgcgggctgcgcgagctcgggctcgaggcccagctcaacacgaacatggtgttgttgcgacttcccgccgagagggcggcgccactggaagcacacctgaagaaacatgatgtgctggtgctgccgcgcgcgccgatgcggctcgtgacgcacctcgacgtcgaccgggccggcatcgatcgggcgctcgccgggttccgcgcgttcttcacgcagaaagaattacgaccctga

SEQ ID NO: 230 - protein, 338 aa, Unknown
  ltaE_23 sequence from unknown bacterial species from environmental sample
MTVDLRSDTVTRPGTGMRKAMMEAELGDDVFGDDPTVNRLQARAAEIFGFEAALLFPSGTQSNLAALMSHCQRGDEVILGMEAHSYRYEAGGLSVLGSIQPQAIPNRPDGTLDLAEVEAAIKPDDPHFARTRLLALENTITGRVLSRSYLEQAIGLAKKKNLSIHLDGARVFNAASALKMPVKDLCAGFDSVSSCLSKGLGAPAGTVLLGSKPFIEKAKRARKILGGGMRQAGVIAAAGLYALEHNVERLNTDHENAERLARGLRELGLEAQLNTNMVLLRLPAERAAPLEAHLKKHDVLVLPRAPMRLVTHLDVDRAGIDRALAGFRAFFTQKELRP

SEQ ID NO: 231 - DNA, 954 bp, Unknown
  ltaE_24 sequence from unknown bacterial species from environmental sample
atggaagccgaactcggcgacgacgtcttcggcgaagacccgaccgtcaaccgcctgcaggcgcgcgcggccgagatgttcggcttcgaggtggcgctcctctttccctccggcacgcaatcgaacctggccgcgctcatgagccactgccagcgcggcgacgaggtgatcctcgggatggaggcgcacagttaccgctacgaagcgggcggcctctcggtgctcggctcgatccagccgcaggcgatccccaatcgccccgacggcacgctcgatctcgccgaagtggaagccgcgatcaagcccgacgatccgcacttcgcgcgcacccgcttgctcgctttggaaaacacgatcacgggccgcgtgctctcaagaagttatctggaacaggccatcggggtggcgaagaaaaaaaacctctcgattcacctcgacggcgcgcgcgtcttcaatgctgccacgcagctcaagatgaaggtaaaggacctctgcgcgggcttcgactcggtgtcctcgtgcctctcgaaggggctcggtgcgcccgccggcacagtgctcttaggtagcaaagctttcatggaaaaagcaaagcgggcaagaaaaatcctcggcggcgggatgcggcaggcaggcgtgatcgccgccgcgggactctacgcgctcgagaacaacgtcgagcgcctgcgcgaggaccacgagaacgccgagcgccttgcgcgcgggctgcgcgaggtcgggctcgaggcgcagctcaacaccaacatggttcttctcaagatcccagtggataaagctgcaccgctggaagcgcatatgaagaggaacaatgtgctcgtgctgccgcgcgcgccgatgcggctcgtgacgcacctcgacgtcgaccgggccggcatcgatcgcgcgctcgccgggttccgcgcgttcttcgcgcagaaagaattacgaccctga

SEQ ID NO: 232 - protein, 317 aa, Unknown
  ltaE_24 sequence from unknown bacterial species from environmental sample
MEAELGDDVFGEDPTVNRLQARAAEMFGFEVALLFPSGTQSNLAALMSHCQRGDEVILGMEAHSYRYEAGGLSVLGSIQPQAIPNRPDGTLDLAEVEAAIKPDDPHFARTRLLALENTITGRVLSRSYLEQAIGVAKKKNLSIHLDGARVFNAATQLKMKVKDLCAGFDSVSSCLSKGLGAPAGTVLLGSKAFMEKAKRARKILGGGMRQAGVIAAAGLYALENNVERLREDHENAERLARGLREVGLEAQLNTNMVLLKIPVDKAAPLEAHMKRNNVLVLPRAPMRLVTHLDVDRAGIDRALAGFRAFFAQKELRP

SEQ ID NO: 233 - protein, 102 aa, Artificial Sequence
  Strain 331829 gapA truncation
MTIRVGINGFGRIGRNFFRAILERSDDLEVVAVNGTKDNKTLSTLLKFDSIMGRLGQEVEYDDDSINEGLRQHRQGCFLVRQRVGLHLPAPASDRARSFQAL

SEQ ID NO: 234 - protein, 71 aa, Artificial Sequence
  Strain 331831 gapA truncation
MTIRVGINGFGRIGRNFFRAILERSDDLEVVAVNGTKDNKTLSTLLKFDSIMGTKDNKTLSTLLKFDSISR

SEQ ID NO: 235 - protein, 93 aa, Artificial Sequence
  Strain 331897 gapA truncation
MTIRVGINGFGRIGRNFFRAILERSDDLEVVAVNGTKDNKTLSTLLKFDSIMGRLGQEVEYDDDSITVGGKRIAVYAERDPKNLDWAATTLTS

SEQ ID NO: 236 - protein, 33 aa, Artificial Sequence
  Strain 331904 gapA truncation
MTIRVGINGFGRIGRNFFVAGAKKVIISRCKRG

SEQ ID NO: 237 - DNA, 63 bp, Artificial Sequence
  pMB038
accgtgcgtgttgactattttacctctggcggtgatactggttgcatgtactaaggaggttgt

SEQ ID NO: 238 - DNA, 57 bp, Escherichia coli
ggaaacacagaaaaaagcccgcacctgacagtgcgggctttttttttcgaccaaagg

SEQ ID NO: 239 - DNA, 5953 bp, Artificial Sequence
  linear p15A plasmid backbone
ggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccactttttcgtgacgcgcggttttgaaaacatagacaagtttttggcgtcgttgttaatttcgaagaggatgtccaatattttttttaaggaataaggatacttcaagactagattcccccctgcattcccatcagaaccgtaaaccttggcgctttccttgggaagtattcaagaagtgccttgtccggtttctgtggctcacaaaccagcgcgcccgatatggctttcttttcacttatgaatgtaccagtacgggacaattagaacgctcctgtaacaatctctttgcaaatgtggggttacattctaaccatgtcacactgctgacgaaattcaaagtaaaaaaaaatgggaccacgtcttgagaacgatagattttctttattttacattgaacagtcgttgtctcagcgcgctttatgttttcattcatacttcatattataaaataacaaaagaagaatttcatattcacgcccaagaaatcaggctgctttccaaatgcaattgacacttcattagccatcacacaaaactctttcttgctggagcttcttttaaaaaagacctcagtacaccaaacacgttacccgacctcgttattttacgacaactatgataaaattctgaagaaaaaataaaaaaattttcatacttcttgcttttatttaaaccattgaatgatttcttttgaacaaaactacctgtttcaccaaaggaaatagaaagaaaaaatcaattagaagaaaacaaaaaacaaaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagcaggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaataggttattactgagtagtatttatttaagtattgtttgtgcacttgcctgcaggccttttgaaaagcaagcataaaagatctaaacataaaatctgtaaaataacaagatgtaaagataatgctaaatcatttggctttttgattgattgtacaggactgggtggaatcccttctgcagcacctggattaccctgttatccctagtcatggtcgtcacagagctggaagcggcagcgagaattatcgcgatcgtggcggtgcccgcaggcatgacaaacatcgtaaatgccgcgtttcgtgtgccgtggccgcccaggacgtgtcagcgccgccaccacctgcaccgaatcggcagcagcgtcgcgcgtcgaaaaagcgcacaggcggcaagaagcgataagctgcacgaatacctgaaaaatgttgaacgccccgtgagcggtaactcacagggcgtcggctaacccccagtccaaacctgggagaaagcgctcaaaaatgactctagcggattcacgagacattgacacaccggcctggaaattttccgctgatctgttcgacacccatcccgagctcgcgctgcgatcacgtggctggacgagcgaagaccgccgcgaattcctcgctcacctgggcagagaaaatttccagggcagcaagacccgcgacttcgccagcgcttggatcaaagacccggacacggagaaacacagccgaagttataccgagttggttcaaaatcgcttgcccggtgccagtatgttgctctgacgcacgcgcagcacgcagccgtgcttgtcctggacattgatgtgccgagccaccaggccggcgggaaaatcgagcacgtaaaccccgaggtctacgcgattttggagcgctgggcacgcctggaaaaagcgccagcttggatcggcgtgaatccactgagcgggaaatgccagctcatctggctcattgatccggtgtatgccgcagcaggcatgagcagcccgaatatgcgcctgctggctgcaacgaccgaggaaatgacccgcgttttcggcgctgaccaggctttttcacataggctgagccgtggccactgcactctccgacgatcccagccgtaccgctggcatgcccagcacaatcgcgtggatcgcctagctgatcttatggaggttgctcgcatgatctcaggcacagaaaaacctaaaaaacgctatgagcaggagttttctagcggacgggcacgtatcgaagcggcaagaaaagccactgcggaagcaaaagcacttgccacgcttgaagcaagcctgccgagcgccgctgaagcgtctggagagctgatcgacggcgtccgtgtcctctggactgctccagggcgtgccgcccgtgatgagacggcttttcgccacgctttgactgtgggataccagttaaaagcggctggtgagcgcctaaaagacaccaagggtcatcgagcctacgagcgtgcctacaccgtcgctcaggcggtcggaggaggccgtgagcctgatctgccgccggactgtgaccgccagacggattggccgcgacgtgtgcgcggctacgtcgctaaaggccagccagtcgtccctgctcgtcagacagagacgcagagccagccgaggcgaaaagctctggccactatgggaagacgtggcggtaaaaaggccgcagaacgctggaaagacccaaacagtgagtacgcccgagcacagcgagaaaaactagctaagtccagtcaacgacaagctaggaaagctaaaggaaatcgcttgaccattgcaggttggtttatgactgttgagggagagactggctcgtggccgacaatcaatgaagctatgtctgaatttagcgtgtcacgtcagaccgtgaatagagcacttaaggtctgcgggcattgaacttccacgaggacgccgaaagcttcccagtaaatgtgccatctcgtaggcagaaaacggttcccccgtagggtctctctcttggcctcctttctaggtcgggctgattgctcttgaagctctctaggggggctcacaccataggcagataacgttccccaccggctcgcctcgtaagcgcacaaggactgctcccaaataatgagtagtcctcatctccctcaagcaggcgccggcggtactgccatcctcgagactacctagctgcattttcaggaggaagcgatgggcggccgcacaccttcttaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccaggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctatgataatgggtgagtgagtgtgtgcgtgtggggcgcgccagatgggaacacttagctttgacctgcacaaatagttgcaaattgtcccacatacacataaagtagcttgcgtatttaaaattatgaacctaaggggtttagcacttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatggagaaaaagatcacgggctacactaccgtggacatctcgcaatggcatcgcaaggaacacttcgaggcatttcaaagcgtggcacaatgtacttacaaccagaccgtccagctggatattaccgcgtttttgaagaccgttaagaaaaacaagcacaagttttatccagcctttatccatattctcgcccgcttgatgaatgcgcaccccgaatttcgtatggccatgaaagatggtgagctcgttatctgggactcagtccatccatgctataccgttttccacgaacaaactgaaactttttcttcgctgtggtccgaatatcacgatgatttccgccaatttttgcatatctacagccaagatgtcgcgtgctatggtgaaaacctggcttactttcccaagggattcatcgagaatatgttctttgtttcagcaaacccctgggtgtccttcacgtcgtttgacttgaacgtggccaatatggataatttcttcgctccagttttcaccatgggtaagtactatacccaaggagacaaggtccttatgccacttgcaatccaagtacaccacgcagtctgcgatggtttccatgtgggacgcatgcttaacgaactccaacagtactgtgatgaatggcaaggcggcgcgtagccccccaaccgaagttgaggggatttttactccagtctttctagaagatggcaaacagctattatgggtattatgggtgctccccgaaaagtgccacctg

SEQ ID NO: 240 - DNA, 3423 bp, Corynebacterium glutamicum
gtgtcgactcacacatcttcaacgcttccagcattcaaaaagatcttggtagcaaaccgcggcgaaatcgcggtccgtgctttccgtgcagcactcgaaaccggtgcagccacggtagctatttacccccgtgaagatcggggatcattccaccgctcttttgcttctgaagctgtccgcattggtactgaaggctcaccagtcaaggcgtacctggacatcgatgaaattatcggtgcagctaaaaaagttaaagcagatgctatttacccgggatatggcttcctgtctgaaaatgcccagcttgcccgcgagtgcgcggaaaacggcattacttttattggcccaaccccagaggttcttgatctcaccggtgataagtctcgtgcggtaaccgccgcgaagaaggctggtctgccagttttggcggaatccaccccgagcaaaaacatcgatgacatcgttaaaagcgctgaaggccagacttaccccatctttgtaaaggcagttgccggtggtggcggacgcggtatgcgctttgtttcttcacctgatgagctccgcaaattggcaacagaagcatctcgtgaagctgaagcggcattcggcgacggttcggtatatgtcgaacgtgctgtgattaacccccagcacattgaagtgcagatccttggcgatcgcactggagaagttgtacacctttatgaacgtgactgctcactgcagcgtcgtcaccaaaaagttgtcgaaattgcgccagcacagcatttggatccagaactgcgtgatcgcatttgtgcggatgcagtaaagttctgccgctccattggttaccagggcgcgggaaccgtggaattcttggtcgatgaaaagggcaaccacgtcttcatcgaaatgaacccacgtatccaggttgagcacaccgtgactgaagaagtcaccgaggtggacctggtgaaggcgcagatgcgcttggctgctggtgcaaccttgaaggaattgggtctgacccaagataagatcaagacccacggtgcagcactgcagtgccgcatcaccacggaagatccaaacaacggcttccgcccagataccggaactatcaccgcgtaccgctcaccaggcggagctggcgttcgtcttgacggtgcagctcagctcggtggcgaaatcaccgcacactttgactccatgctggtgaaaatgacctgccgtggttccgattttgaaactgctgttgctcgtgcacagcgcgcgttggctgagttcaccgtgtctggtgttgcaaccaacattggtttcttgcgtgcgttgctgcgtgaagaggacttcacttccaagcgcatcgccaccggatttatcggcgatcacccacacctccttcaggctccacctgcggatgatgagcagggacgcatcctggattacttggcagatgtcaccgtgaacaagcctcatggtgtgcgtccaaaggatgttgcagcaccaatcgataagctgcccaacatcaaggatctgccactgccacgcggttcccgtgaccgcctgaagcagcttggaccagcagcgtttgcccgcgatctccgtgagcaggacgcactggcagttactgataccaccttccgcgatgcacaccagtctttgcttgcgacccgagtccgctcattcgcactgaagcctgcggcagaggccgtcgcaaagctgactcctgagcttttgtccgtggaggcctggggcggtgcgacctacgatgtggcgatgcgtttcctctttgaggatccgtgggacaggctcgacgagctgcgcgaggcgatgccgaatgtgaacattcagatgctgcttcgcggccgcaacaccgtgggatacaccccatacccagactccgtctgtcgcgcgtttgttaaggaagctgccacctccggcgtggacatcttccgcatcttcgacgcgcttaacgacgtctcccagatgcgtccagcaatcgacgcagtcctggagaccaacaccgcggtcgctgaagtggctatggcttattctggtgatctttccgatccgaatgaaaagctctacaccctggattactacctgaagatggcagaggagatcgtcaagtctggcgctcacattctggctattaaggatatggctggtctgcttcgcccagctgcagccaccaagctggtcaccgcactgcgccgtgaatttgatctgccagtgcacgtgcacacccacgacactgcgggtggccagctggcaacctactttgctgcagctcaagctggtgcagatgctgttgacggtgcttccgcaccactgtctggcaccacctcccagccatccctgtctgccattgttgctgcattcgcgcacacccgtcgcgataccggtttgagcctcgaggctgtttctgacctcgagccatactgggaagcagtgcgcggactgtacctgccatttgagtctggaaccccaggcccaaccggtcgcgtctaccgccacgaaatcccaggcggacagttgtccaacctgcgtgcacaggccaccgcactgggccttgcggatcgtttcgaactcatcgaagacaactacgcggcagttaatgagatgctgggacgcccaaccaaggtcaccccatcctccaaggttgttggcgacctcgcactccacctcgttggtgcgggtgtggatccagcagactttgctgccgatccacaaaagtacgacatcccagactctgtcatcgcgttcctgcgcggcgagcttggtaaccctccaggtggctggccagagccactgcgcacccgcgcactggaaggccgctccgaaggcaaagcacctttgacggaagttcctgaggaagagcaggcgcacctcgacgctgatgattccaaggaacgtcgcaacagcctcaaccgcctgctgttcccgaagccaactgaagagttcctcgagcaccgtcgccgcttcggcaacacctctgcgctggatgatcgtgaattcttctacggcctggtcgaaggccgcgagactttgatccgcctgccagatgtgcgcaccccactgcttgttcgcctggatgcgatctctgagccagacgataagggtatgcgcaatgttgtggctaacgtcaacggccagatccgcccaatgcgtgtgcgtgaccgctccgttgagtctgtcaccgcaaccgcagaaaaggcagattcctccaacaagggccatgttgctgcaccattcgctggtgttgtcactgtgactgttgctgaaggtgatgaggtcaaggctggagatgcagtcgcaatcatcgaggctatgaagatggaagcaacaatcactgcttctgttgacggcaaaatcgatcgcgttgtggttcctgctgcaacgaaggtggaaggtggcgacttgatcgtcgtcatttcctaa

SEQ ID NO: 241 - protein, 1140 aa, Corynebacterium glutamicum
VSTHTSSTLPAFKKILVANRGEIAVRAFRAALETGAATVAIYPREDRGSFHRSFASEAVRIGTEGSPVKAYLDIDEIIGAAKKVKADAIYPGYGFLSENAQLARECAENGITFIGPTPEVLDLTGDKSRAVTAAKKAGLPVLAESTPSKNIDDIVKSAEGQTYPIFVKAVAGGGGRGMRFVSSPDELRKLATEASREAEAAFGDGSVYVERAVINPQHIEVQILGDRTGEVVHLYERDCSLQRRHQKVVEIAPAQHLDPELRDRICADAVKFCRSIGYQGAGTVEFLVDEKGNHVFIEMNPRIQVEHTVTEEVTEVDLVKAQMRLAAGATLKELGLTQDKIKTHGAALQCRITTEDPNNGFRPDTGTITAYRSPGGAGVRLDGAAQLGGEITAHFDSMLVKMTCRGSDFETAVARAQRALAEFTVSGVATNIGFLRALLREEDFTSKRIATGFIGDHPHLLQAPPADDEQGRILDYLADVTVNKPHGVRPKDVAAPIDKLPNIKDLPLPRGSRDRLKQLGPAAFARDLREQDALAVTDTTFRDAHQSLLATRVRSFALKPAAEAVAKLTPELLSVEAWGGATYDVAMRFLFEDPWDRLDELREAMPNVNIQMLLRGRNTVGYTPYPDSVCRAFVKEAATSGVDIFRIFDALNDVSQMRPAIDAVLETNTAVAEVAMAYSGDLSDPNEKLYTLDYYLKMAEEIVKSGAHILAIKDMAGLLRPAAVTKLVTALRREFDLPVHVHTHDTAGGQLATYFAAAQAGADAVDGASAPLSGTTSQPSLSAIVAAFAHTRRDTGLSLEAVSDLEPYWEAVRGLYLPFESGTPGPTGRVYRHEIPGGQLSNLRAQATALGLADRFELIEDNYAAVNEMLGRPTKVTPSSKVVGDLALHLVGAGVDPADFAADPQKYDIPDSVIAFLRGELGNPPGGWPEPLRTRALEGRSEGKAPLTEVPEEEQAHLDADDSKERRNSLNRLLFPKPTEEFLEHRRRFGNTSALDDREFFYGLVEGRETLIRLPDVRTPLLVRLDAISEPDDKGMRNVVANVNGQIRPMRVRDRSVESVTATAEKADSSNKGHVAAPFAGVVTVTVAEGDEVKAGDAVAIIEAMKMEATITASVDGKIERVVVPAATKVEGGDLIVVVS

SEQ ID NO: 242 - DNA, 3549 bp, Unknown
  pyc_1 sequence from unknown bacterial species from environmental sample
gtgttcagcaaggtgctggtcgccaaccgcggggagatcgcgatccgggcgtttcgtgccgcctacgaactgggttgccagacggtggcggtgttcccttacgaggatcgcaactccgaacaccggctcaaggcaaacgaggcctacgagatcggcgagaagggccatccggttcgggcctatctctcggtggaagagatcgtccgggcggcgcagcgcgccggggccgacgccgtctaccccggttacggcttcctgtcggagaatccgaagctggccacggcctgccggcaggccggtatcactttcgtcgggccgccacctgcggtgctggccctggccggcaacaagtcacgggcggtggccgcggcgcgcgaagccagagtgccggtgctggaatcctgcgccccgtccgccgatatcgaccagctgatggccgcggccgacgagatcgggttccccatattcgtcaaggccgtcgccggcggcggtgggcgtggcatgcgcagggtcacctcgctgcgtggcctgcgcgatgcactggaggcggcctcccgcgaggctgaatcgacgttcggggacccgaccgtgttcctggagcgggccgtcatcgaacctcggcacatcgaggcgcaggtcctcgcagactcgaccggcgaggtgatccacctctatgagcgagactgctcggtacagcggcgccaccagaaagtcgtagagatcgcccccgcgcccaacctggaccctgatctgcgggcgcgaatctgtgccgatgcggtggccttcgcccggcagatcggctacgtcaacgcgggcaccgtggagttccttgtcgaccgcgcgggcaaccatgtgttcatcgagatgaacccgcgcatccaagtcgagcacaccgtcaccgaggaaatcaccgatatcgacctggtcgcctcccaactgcgcatcgcggcgggggagacgctggccgacctcgggttgtcccaagacgcgatcgtgccgcatggcgccgcgctgcaatgccggatcaccaccgaggacccggccaacgacttccgtccggacatcggaacggtcaccgcgtaccgctccgccagcggcgccggagttcggctggacggcggcaccgtatacccgggtgcgcagataggtccgcatttcgactccttgctggtcaaggtgacgtgccggggacgggacctggggtctgccgtgctgcgggcgcggcgcgcgatcgccgagttccggatccgcggggtacacacgaacatcccgttcctgctcgccctgctcgacgaaccggatctccaggcgggcaaggtcaccacctcgttcatcgagcaacggccgtacttgctcaccacgcgccagtccgccgaccgcggcacccggttgctgacctacctcggccacatgacggtgaatcggccgcacggtgagccccccgagctggtcgacccgatgctcaagctcccgccgatcgacctggacgcgccaccacctaccggatcccggcagcagctccgcgcgctgggcccggaaggcttcgcgcgctggttgcggacccgcgacagtgtcggcgtcaccgacaccaccttccgcgacgcccaccagtcactgctcgctacccgagtgcgcagcaaggacctcgttgcggtggcgccctacgtgacccggatgacctcgcaactgctgtcgttggagtgctggggtggcgcgacctacgacgtggcgctgcgcttcctcgccgaggacccctgggagcgactggccgcattgcgtgaagcggtccccaacctgtgcctgcagatgttgctgcgcgggcgcaacaccgtcggctacacgccttaccccaccgaggtgactgcggccttcgtcgagcaggccgtcgagaccggcctggacatttttcgcatcttcgacgcgctcaacgacatctcccagatgcgccccgccatcgacacggtgcgcgagaccggccgggccatcgccgaggtggcgctgtgctataccgccgatctgtccgatccggcggagaagctgtacacgctggactattacctgcggctggccgaggagatcgtggcggccggcgcgcacgtgctggccatcaaggacatggcgggcctgctacgaccccccgcggcccgcacgctggtgaccgcgctgcgcagccggttcgatctccccgtgcacctgcatacccacgacacacctggtgggcagctggccaccctgctcgcagcgatcgacgccggggtagatgcggtcgatgccgccaccgcctcgatggccggcaccacgtcgcagccatcgctatccgcgctggtagcggctactgaccacaccgagcgcagcaccgggctgaacctgcaggcggtctgtgatctggagccctactgggaactggtgcgcaaggtctacgcgcccttcgagtccggcctggcctcgcccaccggtcgggtgtatcaccacgagatccctggtggccagctatccaacctgcgccagcaagccgtggcgttgggcctggcggacaagttcgagcagatcgaacaagcctacgcagcggctgaccggatgctcggcaggttgatcaaggtgaccccttcctccaaggtcgtgggagatctggcgctgcacctggtcggtgccggtgtcgagccgacagacttcgaggccgatccggctcggttcgacatccccgactcggtgatcggattcctgcacggcgaactcggtgatcctcccggcggctggcccgaacccctgcgcagcaaggcgctcaagggtcgcagcgaccccaaggggatcgcggagctgtccgccgaggaccgcaagggccttcgcgaggaccgggcgcgcaccctcaaccggctgctgttcgctggtcccaccgcagacttcgaagagcatcgcgagtcctacggggatacctcggtactgcccagcaaggagttcttctacgggctgcgttccggtcaggagcatgcggtagatctcgaaccgggggtgcggctgctgatccagcttcaggcgatcggcgatgctgacgaacgcggcctgcgcaccgtgatgtgcaccctcaacgggcagttgcggccactgcagatccgggatcactccatcgactcggagatcccggttgcagagcgagccaacaaatccgacagcaaccatgttgcggcgccgttcgcgggggtggtcaccctgcaggtgtccgaaggggacaccgtgtctgccgggcagctggtggccggtgcccttctggcgccacggcttcttgcccgagccgctcacctccgcacgcgtcttcgtcgcgtgcgtgccgcgacgctcggcggcgttggcgtgcaccacggactcgtggatcaggtccgtcttgatgcggcccccgaacagctcgtcgctcaggtcgaccgagccgaccttctcgttctgctggttcacgacatctacggtcatggctacttcttgcccttcttcttcgccggctcggcctgtgcgaccttgatgcgcttggcggccaccgctttgcggatcgtcacgtag

SEQ ID NO: 243 - protein, 1182 aa, Unknown
  pyc_1 sequence from unknown bacterial species from environmental sample
VFSKVLVANRGEIAIRAFRAAYELGCQTVAVFPYEDRNSEHRLKANEAYEIGEKGHPVRAYLSVEEIVRAAQRAGADAVYPGYGFLSENPKLATACRQAGITFVGPPPAVLALAGNKSRAVAAAREARVPVLESCAPSADIDQLMAAADEIGFPIFVKAVAGGGGRGMRRVTSLRGLRDALEAASREAESTFGDPTVFLERAVIEPRHIEAQVLADSTGEVIHLYERDCSVQRRHQKVVEIAPAPNLDPDLRARICADAVAFARQIGYVNAGTVEFLVDRAGNHVFIEMNPRIQVEHTVTEEITDIDLVASQLRIAAGETLADLGLSQDAIVPHGAALQCRITTEDPANDFRPDIGTVTAYRSASGAGVRLDGGTVYPGAQIGPHFDSLLVKVTCRGRDLGSAVLRARRAIAEFRIRGVHTNIPFLLALLDEPDLQAGKVTTSFIEQRPYLLTTRQSADRGTRLLTYLGHMTVNRPHGEPPELVDPMLKLPPIDLDAPPPTGSRQQLRALGPEGFARWLRTRDSVGVTDTTFRDAHQSLLATRVRSKDLVAVAPYVTRMTSQLLSLECWGGATYDVALRFLAEDPWERLAALREAVPNLCLQMLLRGRNTVGYTPYPTEVTAAFVEQAVETGLDIFRIFDALNDISQMRPAIDTVRETGRAIAEVALCYTADLSDPAEKLYTLDYYLRLAEEIVAAGAHVLAIKDMAGLLRPPAARTLVTALRSRFDLPVHLHTHDTPGGQLATLLAAIDAGVDAVDAATASMAGTTSQPSLSALVAATDHTERSTGLNLQAVCDLEPYWELVRKVYAPFESGLASPTGRVYHHEIPGGQLSNLRQQAVALGLADKFEQIEQAYAAADRMLGRLIKVTPSSKVVGDLALHLVGAGVEPTDFEADPARFDIPDSVIGFLHGELGDPPGGWPEPLRSKALKGRSDPKGIAELSAEDRKGLREDRARTLNRLLFAGPTADFEEHRESYGDTSVLPSKEFFYGLRSGQEHAVDLEPGVRLLIQLQAIGDADERGLRTVMCTLNGQLRPLQIRDHSIDSEIPVAERANKSDSNHVAAPFAGVVTLQVSEGDTVSAGQLVAGALLAPRLLARAAHLRTRLRRVRAATLGGVGVHHGLVDQVRLDAAPEQLVAQVDRADLLVLLVHDIYGHGYFLPFFFAGSACATLMRLAATALRIVT

SEQ ID NO: 244 - DNA, 3405 bp, Unknown
  pyc_2 sequence from unknown bacterial species from environmental sample
gtgttccagaagattctcgtggccaaccgcggtgagatcgcgatccgcgcgttccgcgccgcgtacgagctcggcgtgcgcaccgtcgctgtcttcccctacgaggaccgcggctccacccaccgcatgacggcggacgaggcgtaccagatcggcgagccgggacaccccgtgcgcgcctacctcgatgtcgacgagatcatccgcgtggcgaaggagtgcggcgccgacgccatctatcccggctacgggttcctctcggagaacccggcgctcgccgaggcggcgcaggaggcgggcatcacgttcgtcgggccgcccgcccgcgtgctcgagatagccgggaacaaggtcaccgcgaaggagcgcgcgatcgccgccggggtgccggtgctggcgtcgacgccggcgtcgcgcgacctcgacgagctcgtgcgcgcggccgacgacctcggcttcccggtgttcgccaaggcggtcgccggcggaggggggcgcggcatgcgccgcgtcgacacgcgcgaagagctgccggccgccctcgaggaggccatgcgcgaggcggagaccgcgttcggcgaccccacgatgttcctcgagcaggccttcccgcagccccggcacatcgaggtgcagatcctcgcggacggccacggcgacgtggtgcacctcttcgagcgcgactgctccgtgcagcggcgccaccagaaggtgatcgagatcgcgcccgcgcccaacgtcgaccagccgctgcgcgaggcgctctaccgcgacgccgtcgcgttcgcgcgatccatcggctacgtgaacgccggcacggtcgagttcctcgtggacaccgccggcgagcgcgccgggcagcacgtgttcatcgagatgaacccacgcatccaggtggagcacacggtcaccgaggaggtgacggacgtcgacctcgtgcaggcgcagatgcgcatcgcggccggcgagcggctgagcgacctcggcatccggcaggagagcctccaactgcgaggcgccgcgatgcagtgccgcatcacgaccgaggatccgatgaacggattccgcccggacgtcggccgcatcacaacgtaccgctcgcccggcggcgccggcatccgcctggacggcggcacgatcaacctcggcagcgagatcggaccgtacttcgactcgatgctcgtgaagctcacgtcgcgcgcgggcgacttccccgccgcggtgagccgcgcgcggcgcgccctcgcggagttccgcatccgaggcgtatcgacgaacattccgttcctgcaggcggtcgtcgccgacccggacttcatcgccggcaacttcacgacctcgttcatcgacgagcggccgtacctgctcaacgcgaaccgctcgaacgaccgcggcaccaaggtgctgagctggctcgccgacgtcacggtgaaccagccgcacggacgccgcggcaagatcgtcagtccgtggcacaagctgcccgccgtggacatcgaggcgcccgcaccgccgggctcgcgcgaccggctgcgggcgctcggcccggcggcgttcgcgcgttcgctgcgggagcagacgccgctcgccgtgacggagacgacgttccgcgatgcgcaccagtcgctgctggcgacgcgcgtgcgcacgcgcgacctcgtgagtgtggcgccgtacgtggcgcgcacgacgccgcagttgctctcgatcgaggcgtggggcggcgcgacgtacgacgcgtcgctgcgcttcctgggcgaggacccgtgggagcggctggcggcgctgcgcgaggcgctgcccaacgtgaacatccagatgctgctgcgcggccgcaacaccgtcggctacacgccctaccccgaggaggtgaccgacgccttcgtgcgggaggcggcgaccaccggcgtcgacatcttccgcatcttcgacgcgctgaacgacgtctcgcagatgcgcccggcgatcgagtcggtgctcgcgacgggtaccggcatcgccgaggtcgcgttctgctacacgggcgacctgctggaccccaacgagacgctgtacacgctcgactactacctgaagctcgccgaggagatcgtcggcaccggcgcgcacatcctcgcgatcaaggacatggccggactgctccgcccgcgcgccgccgaggtgctcgtgcgcgcgctgcgcgagcgcttcgacctgccggtccacctgcacacgcacgacaccccgggcggccagctcgcgacgctgctcgcggcgagcggcgccggcgtcgacgccgtcgacgtcgcgagcgcgccgatggccggcaccacgagccagccgccgatctcggcgctggtcgcggcgctcgcgcacaccgaccgcgacacgggcctctcgctgcaggccgtgtgcgacctcgagccgtactgggaggccgtgcgtacggcgtaccggccgttcgagtcgggtctgtccgcgcccaccggccgcgtctacaagcacgagatcccgggcgggcagctctccaacctccgccagcaggcgatcagcatgggcatgggcgagcagttcgagaaggtcgaggactggtacgccgccgcgaacgagatcctcggccggccgccgaaggtcacgccgtcctcgaaggccgtgggcgacctcgcgatctacctcgcggcggtgaacgcggaccgcgcggacttcgaggcgcacccggagcgctacgacatcccggagtcggtgatcggcttcatggccggcgagctcggcgacctgccgggcggctggcccgagccattccgcagcaagatcctcgagggccggcacgtcgacatcgcggtcacgccgatcagcgacgccgaccgcgaggcgctcgagggcgacaccgcctcgcggcggcaggtgctgaaccggctgctcttcccggacgcgctcgcggtgttccaggaggtgagcgaccagtacggcgacctgtcggtggtcgacaccgtggactacctctacggcctcgaccgcgcgaccgagcacctcgtgcacatcagcaagggcgtcacgctctacatcggcctcgaggcgatcggcgaggtggacgagcgcggcatccgcacggtgatgacgaccctcaacggccagctgcggccggtgtacgtgcacgaccgcagcgtctccgccgccatcctcggcgcggagaaggcagacctgagccagcccggtcacgtggccgcgcccttctcgggcttcgtgacggtgcaggtgcacgtcggcgacaccgtcaccgccggccagacggtcgcgaccatcgaggcgatgaagatggaggccgcgatcacggccgccgtcggcggcgtggtccgccgcgtcgtgatcacggagacgcgccaggtgaacggcggcgacctgctgatgctgatcgagccggtctga

SEQ ID NO: 245 - protein, 1134 aa, Unknown
  pyc_2 sequence from unknown bacterial species from environmental sample
VFQKILVANRGEIAIRAFRAAYELGVRTVAVFPYEDRGSTHRMTADEAYQIGEPGHPVRAYLDVDEIIRVAKECGADAIYPGYGFLSENPALAEAAQEAGITFVGPPARVLEIAGNKVTAKERAIAAGVPVLASTPASRDLDELVRAADDLGFPVFAKAVAGGGGRGMRRVDTREELPAALEEAMREAETAFGDPTMFLEQAFPQPRHIEVQILADGHGDVVHLFERDCSVQRRHQKVIEIAPAPNVDQPLREALYRDAVAFARSIGYVNAGTVEFLVDTAGERAGQHVFIEMNPRIQVEHTVTEEVTDVDLVQAQMRIAAGERLSDLGIRQESLQLRGAAMQCRITTEDPMNGFRPDVGRITTYRSPGGAGIRLDGGTINLGSEIGPYFDSMLVKLTSRAGDFPAAVSRARRALAEFRIRGVSTNIPFLQAVVADPDFIAGNFTTSFIDERPYLLNANRSNDRGTKVLSWLADVTVNQPHGRRGKIVSPWHKLPAVDIEAPAPPGSRDRLRALGPAAFARSLREQTPLAVTETTFRDAHQSLLATRVRTRDLVSVAPYVARTTPQLLSIEAWGGATYDASLRFLGEDPWERLAALREALPNVNIQMLLRGRNTVGYTPYPEEVTDAFVREAATTGVDIFRIFDALNDVSQMRPAIESVLATGTGIAEVAFCYTGDLLDPNETLYTLDYYLKLAEEIVGTGAHILAIKDMAGLLRPRAAEVLVRALRERFDLPVHLHTHDTPGGQLATLLAASGAGVDAVDVASAPMAGTTSQPPISALVAALAHTDRDTGLSLQAVCDLEPYWEAVRTAYRPFESGLSAPTGRVYKHEIPGGQLSNLRQQAISMGMGEQFEKVEDWYAAANEILGRPPKVTPSSKAVGDLAIYLAAVNADRADFEAHPERYDIPESVIGFMAGELGDLPGGWPEPFRSKILEGRHVDIAVTPISDADREALEGDTASRRQVLNRLLFPDALAVFQEVSDQYGDLSVVDTVDYLYGLDRATEHLVHISKGVTLYIGLEAIGEVDERGIRTVMTTLNGQLRPVYVHDRSVSAAILGAEKADLSQPGHVAAPFSGFVTVQVHVGDTVTAGQTVATIEAMKMEAAITAAVGGVVRRVVITETRQVNGGDLLMLIEPV

SEQ ID NO: 246 - DNA, 3408 bp, Unknown
  pyc_3 sequence from unknown bacterial species from environmental sample
atgtttggcaaggtactggtcgctaatcgtggcgagatcgcggtccgagcctttcgcgcggcgtacgagctgggcgtgaggaccgtcgcggtgttcgcctacgaggaccgaaacgcggtccaccggatcaaggcggatgaggcgtacttgatcggtgagcggggtcacccggtacgcgcctatctcgatatcaacgagatcatgcgggctgccaagcagtctgaggcagatgcgatctatcccggctacggcttcctgagcgaaaatcccgaccttgcccgggcgtgtgaagacgccggcataaccttcatcggtccgcctgccaaagtgctggagcttgccgggaacaaggtccacgccatcgaggcagccaaggccgcaggcgtgccaaccctcacctcaacgccaccgtcggccaacatcgaggagctgatggcaagtgccgaaagcatcggctttccggcgttcgttaaggcggttgccggtggcggtggccgcggcatgcggcggatcgcggaccgcgatcagctcagagaatcgctatctgccgcgatgcgcgaggccgaaggcgcgttcggcgacccgacggcatacatcgagcaggcggtaggccggccgcggcacatcgaggtgcaggtactcgctgacagtcagggcgacaccatccatctgttcgagcgcgactgttcggtgcagcgacggcaccaaaagatcattgagattgcaccggctccgcacatctcgactgagttgcgcgaggcgttgtgtcgtgatgcggtgcggttcgctgaatcgatcgattactcctgcgccggcactgtcgagtttctggttgagaccgagggtgagcgggccggtcagcacgtcttcatcgagatgaatcctcgaatccaggtggagcacaccattactgaggagatcaccgatgttgatcttgtgcaggcccagatgcggattgctgcaggggaaagccttactgatcttggtctgtcacaggaagcgattcggatcaacggggccgcgctgcaatgccgaatcaccaccgaggatcctgcgaacgatttccggcccgatacgggcaccattaccgcctatcgttccgcgggcggtgcgggcgtgcggatcgacggtggcacggtcgacatcggcgttgaaatcagcgcatatttcgactccctgctggtcaagctcatctgtcacgggtgggatttccaggcggcagtgacccgagcccggcgggcgcttgccgagttccggatccgcggcgtaagcaccaacattccttttctgcaagccgttctggccgatcccaagttcagagcaggtgacgtctcgacatcctttatcgaggagcggcccgacctgctgaccgcgcacgcgcccgccgaccggggcaccaaattgctgcgctggctggcggaggtaacggtcaaccagccgcatggaccagcaccgactcaactcgatccaggcctgaagcgacctaccggcatcgatctcaccatcccatcccccaccggctcacggcagcggcttcttgatcttggtccagaggctttcgccgaggatctgcggcaacgggtgccgatcgaggtaactgacacaaccttccgcgacgctcaccagtccctgcttgcgactcgggttcgtaccaaggatttgatacgtattgcgccctatgtgggacgcatgacaccgcagctgctctcggtcgagtgctggggcggggcaacctacgacgtggcgctgcgcttcatcgccgaggacccgtgggaacgcctcgccgcgctgcgctacaacatgccaggtctgtgcctgcaaatgctcttacgcggacgcaacacggtcggttatacgccgtacccaacgaaggtcaccacttcattcgtggccgaagctgcccaagtcggtatcgacatcttccgcatcttcgatgcgctcaacgacgtcgagcagatgcggccagcgatcgaggcggtacgagagaccggcagcaccatcgccgaggtagccctgtgctacaccggcgacctcaactcaccggccgaggacctgtacaccctggactactacctgcgactggccgagaagatggtcaaggccggtgctcacatcatcgggatcaaggacatggctgggctgctccggccgcctgcggctcggaagttggtcaccgcactacggcagaacttcgacctcccggtgcatctgcacacccacgacaccgccggtggtcagctggcgacactgctcgccgccatcgaggttggagtcgatgcagtcgatgtggccagcgccccgatggccggaaccaccagtcaggtgcccgcttcagcactggtcgcggcctgcgcgaatactgagcggcccaccaaccttgacctgcgagacgtgatggagcttgagccgtactgggaggcggttcggaaggtgtatgcgccgttcgagtcaggactgccgagcccaaccggccgggtctatgaccacgagatccccggtggccagctctccaatctccggcagcaggcaattgctctgggactgggggagaagtttgagcaaattgaggctatgtataccgccgcgagccgcatcttgggtaggccgcccaaggtcacaccgtcctcgaaagtcgttggtgatcttgctttacacctagttgcggttggagccgatccggacgacttcgcccagaaccctcacaagtacgacatcccggattcagtgatcggtttcctcaacggtgagctaggtgatccgcccggcggctggccggagccgttccgcaccaaggcgctacaggggcgtaccgtgccggtacgcgacatcgagctttcgcccgaggactcagccaaccttgacgacaaaggtttggtgcgacagagcacgctgaaccgcttgctgttccccgggccgaccaaggagttcctggccaaccgggaaacctacggcgatgtgggtcggcttaacaccctggacttcctctacgggttacagcccggtcaggagcaccttgccaagatcggtaagggtgtcagcctgatactcgggctttcggcgatcggcaacgccgacgaacggggcatgcgtaccgttatgtgcacgatcaacggacagctgcggcccatccgagttcgcgacaagtcgatcaaggtcgatgttaagactgccgagcgtgcggatccgaacaatccgggtcatgtggcggcaccgttcgccggcgtggtcaccgttacggtgcgtgagggcgatcaggtccaggctggtgccaccgttgccacgatcgaggcgatgaagatggaagccgcgattactacgccggtgtcaggcgtggtacagcggctggcactcgctgacgtgcagcaagttgagggcggtgacctcgtcctggtggttgccgctgcctaa

SEQ ID NO: 247 - protein, 1135 aa, Unknown
  pyc_3 sequence from unknown bacterial species from environmental sample
MFGKVLVANRGEIAVRAFRAAYELGVRTVAVFAYEDRNAVHRIKADEAYLIGERGHPVRAYLDINEIMRAAKQSEADAIYPGYGFLSENPDLARACEDAGITFIGPPAKVLELAGNKVHAIEAAKAAGVPTLTSTPPSANIEELMASAESIGFPAFVKAVAGGGGRGMRRIADRDQLRESLSAAMREAEGAFGDPTAYIEQAVGRPRHIEVQVLADSQGDTIHLFERDCSVQRRHQKIIEIAPAPHISTELREALCRDAVRFAESIDYSCAGTVEFLVETEGERAGQHVFIEMNPRIQVEHTITEEITDVDLVQAQMRIAAGESLTDLGLSQEAIRINGAALQCRITTEDPANDFRPDTGTITAYRSAGGAGVRIDGGTVDIGVEISAYFDSLLVKLICHGWDFQAAVTRARRALAEFRIRGVSTNIPFLQAVLADPKFRAGDVSTSFIEERPDLLTAHAPADRGTKLLRWLAEVTVNQPHGPAPTQLDPGLKRPTGIDLTIPSPTGSRQRLLDLGPEAFAEDLRQRVPIEVTDTTFRDAHQSLLATRVRTKDLIRIAPYVGRMTPQLLSVECWGGATYDVALRFIAEDPWERLAALRYNMPGLCLQMLLRGRNTVGYTPYPTKVTTSFVAEAAQVGIDIFRIFDALNDVEQMRPAIEAVRETGSTIAEVALCYTGDLNSPAEDLYTLDYYLRLAEKMVKAGAHIIGIKDMAGLLRPPAARKLVTALRQNFDLPVHLHTHDTAGGQLATLLAAIEVGVDAVDVASAPMAGTTSQVPASALVAACANTERPTNLDLRDVMELEPYWEAVRKVYAPFESGLPSPTGRVYDHEIPGGQLSNLRQQAIALGLGEKFEQIEAMYTAASRILGRPPKVTPSSKVVGDLALHLVAVGADPDDFAQNPHKYDIPDSVIGFLNGELGDPPGGWPEPFRTKALQGRTVPVRDIELSPEDSANLDDKGLVRQSTLNRLLFPGPTKEFLANRETYGDVGRLNTLDFLYGLQPGQEHLAKIGKGVSLILGLSAIGNADERGMRTVMCTINGQLRPIRVRDKSIKVDVKTAERADPNNPGHVAAPFAGVVTVTVREGDQVQAGATVATIEAMKMEAAITTPVSGVVQRLALADVQQVEGGDLVLVVAAA

SEQ ID NO: 248 - DNA, 3486 bp, Unknown
  pyc_4 sequence from unknown bacterial species from environmental sample
ttggggaccctcctggacgggcagccggacaggcgggagggtccgccgtcccatgagaaggtgtcccccggagtgacgacccgagggggacacatgttcggcaaggtcctggtcgccaaccgaggcgagatcgcgatccgcgcgttccgcgccgcctacgagatgggcgcgcagaccgtcgcggtgttcccctacgaggaccgcaactccgagcaccggctcaaggccgacgaggcctaccagatcggcgagctgggccgaccggtacgcgcctacctcgacgtcgacgcgatcgtgcgtacggcggtccgcgccggcgccgacgcggtctaccccggatacggcttcctgtccgagaacccccagctcgcggaggcctgtgccgccgcggggatcgccttcatcggtcccagcgccgaggtgctcgagctcaccgggaacaaggcccgcgcgatcgcggcggcgcgcaaggccggagtgccgacgctcagcagcgtcgcccccgggaccgaccccgcagcgctagtcgaggctgcccgagagctcgccttcccgctgttcgtcaaggcggtcgccggtggcggcggtcgcggcatgcggcgcgtggacgaccccgcggtcctcgaggaggccgtgcggacctgtatgcgcgaggccgacagtgccttcggcgacccgacggtcttcatcgagcaggccgtcgtcgacccgcgccacatcgaggtccagatcctcgccgacgggcagggcgaggtccttcacctgttcgagcgcgactgctcggtgcagcgacgccaccagaaggtcgtcgagatcgcgccggcgcccaacctcgaccccgggctgcgcgaccggatgtgcgccgacgcggtgcggttcgcgcgcgagatcggctacacgaatgccggcaccgtcgagttcctcctggacccgcagggccgctacgtgttcatcgagatgaacccccgcatccaggtcgagcacaccgtgaccgaggaggtcaccgacgtcgacctggtccgcagccagatgcgcatcgcgtcgggggagacgctggccgacctcgggctcacccaggaggacatccggctccgcggcgccgcgctgcagtgccggatcaccaccgaggacccggcgaacggcttccgccccgacacgggcgtcatcacgacgtatcgctccccgggcggcgccggtatccggctcgacggcgggacgacctacaccggcgcggagatctccggtcacttcgactcgatgctcgccaagctcacctgccgcggccgcgacttcaccaccgcggtcgagcgctcgcgccgggcggtggcggagttccggatccgcggcgtcgccacgaacatccccttcctccaggccgtcctcgacgacccggacttcgcccgcggcggggtgaccaccggcttcatcgaggagcggccccacctgctcaccgcgcgctcgagcgccgaccggggcaccaagctgctcaactacctcgccgacgtcaccgtcaaccagccgtacggcgcgcttcaggtcggggtcgacccccgggcgaagctcccgcccgtcgacctcgccgcaacgccaccctccggaacccgtcaactcctctgcgacgtcgggcctgaggagttcgctcgccggctgcgccgtcagacccgggtcgccgtcaccgacaccacgttccgcgacgcccaccagtcgctgctcgccacccgcatccgcacccgcgacctgctgggggtcgccggccacgtcgcccggaccaccccagagctctggtcgatcgaggcgtggggcggagccacctacgacgtcgcgctgcgcttcctctccgaggacccgtgggaccggctcgcgcggctgcgtcgagcggtgcccaacatctgcctgcagatgcttctccgcggtcgcaacaccgtgggctacacgccgtacccgaccgaggtgaccgacgccttcgtcgaggaggcggccgccaccgggatcgacgtcttccgggtcttcgacgcgctcaacgacgtggagcagatgcgcccggcggtcgaggccgtccggaggaccgggaccgcggtggccgaggtcgcgctgtgctacaccggcgacctctccgacccggccgagcggctctacaccctcgactactacctgcggctcgccgagcgcatcgtcgaggccggtgcccacgtgctggcgatcaaggacatggccgggctgctccgggcgccggccgcccaccggctggtgaccgcgctgcgcgagcgtttcgacctgccggtgcacctccacacccacgacacccctggcggccagctggcgacgctgctcgccgcgatcgacgcgggggtggacgcggtcgacgccgcgagcgccgcgatggcggggacgaccagccagccggcactgtccgccctggtcgccgccacagaccaccccgtgacggagggccgcgacaccgggctggacctccgcgccgtctgcgacctcgagccctactgggaggccacgagacgggtctacgcgccgttcgagtcggggctgccctcgcccactggtcgggtctacacccacgagatccccggcgggcagctctcgaacctccggcagcaggcgatcgcgctcgggctgggggagaagttcgagcagatcgaggacatgtacgccgcggcgaaccggatcctcgggaacatcgtgaaggtgaccccgtcctccaaggtcgtcggtgacctggcgctccacctcgtggcggtcgacgccgaccccacggcgttcgccgaggaccccgggaagttcgacgtgcccgactcggtcgtcggcttcctcagcggcgacctcggcgatccgcccgggggctggccggagccgttccggacccgggccctcgagggccgtacgacgcgaccggcggtcaccgagctcaccgagggcgatcgcgacgggctcgccgcggaccggagggcgaccctcaaccggttgctgttcccgggccccacccgcgagttcgaggagtcccgacagcggtacggcgacctgtcggtgctgccgacgcggcagtacctctacggtttgcagcagggtgaggagcaccaggtggagctcgccgagggcaagacgctcatcctggggctcgaggcggtcgggggcgcggacgagcgcggcttccgcaccgtcatgtgcacgatcaacggccacctgcgaccggtccccgtccgcgaccgttcggtggcggcggacaccccgacggcggagaaggcggaccccaccaagccagggcaggtcgcggcgccgttcggcggggtcgtcaccccgacggtggcggagggcgacccggtggaggccggggccaccgtggcgaccatcgaggcgatgaagatggaggcgtcgatcacggcgccggtcgggggcacggtgcagcgggtcgcgctcggcggtccgcagcaggtggagggcggcgacctggtgctcgtgatcggacgaggctga

SEQ ID NO: 249 - protein, 1161 aa, Unknown
  pyc_4 sequence from unknown bacterial species from environmental sample
LGTLLDGQPDRREGPPSHEKVSPGVTTRGGHMFGKVLVANRGEIAIRAFRAAYEMGAQTVAVFPYEDRNSEHRLKADEAYQIGELGRPVRAYLDVDAIVRTAVRAGADAVYPGYGFLSENPQLAEACAAAGIAFIGPSAEVLELTGNKARAIAAARKAGVPTLSSVAPGTDPAALVEAARELAFPLFVKAVAGGGGRGMRRVDDPAVLEEAVRTCMREADSAFGDPTVFIEQAVVDPRHIEVQILADGQGEVLHLFERDCSVQRRHQKVVEIAPAPNLDPGLRDRMCADAVRFAREIGYTNAGTVEFLLDPQGRYVFIEMNPRIQVEHTVTEEVTDVDLVRSQMRIASGETLADLGLTQEDIRLRGAALQCRITTEDPANGFRPDTGVITTYRSPGGAGIRLDGGTTYTGAEISGHFDSMLAKLTCRGRDFTTAVERSRRAVAEFRIRGVATNIPFLQAVLDDPDFARGGVTTGFIEERPHLLTARSSADRGTKLLNYLADVTVNQPYGALQVGVDPRAKLPPVDLAATPPSGTRQLLCDVGPEEFARRLRRQTRVAVTDTTFRDAHQSLLATRIRTRDLLGVAGHVARTTPELWSIEAWGGATYDVALRFLSEDPWDRLARLRRAVPNICLQMLLRGRNTVGYTPYPTEVTDAFVEEAAATGIDVFRVFDALNDVEQMRPAVEAVRRTGTAVAEVALCYTGDLSDPAERLYTLDYYLRLAERIVEAGAHVLAIKDMAGLLRAPAAHRLVTALRERFDLPVHLHTHDTPGGQLATLLAAIDAGVDAVDAASAAMAGTTSQPALSALVAATDHPVTEGRDTGLDLRAVCDLEPYWEATRRVYAPFESGLPSPTGRVYTHEIPGGQLSNLRQQAIALGLGEKFEQIEDMYAAANRILGNIVKVTPSSKVVGDLALHLVAVDADPTAFAEDPGKFDVPDSVVGFLSGDLGDPPGGWPEPFRTRALEGRTTRPAVTELTEGDRDGLAADRRATLNRLLFPGPTREFEESRQRYGDLSVLPTRQYLYGLQQGEEHQVELAEGKTLILGLEAVGGADERGFRTVMCTINGHLRPVPVRDRSVAADTPTAEKADPTKPGQVAAPFGGVVTPTVAEGDPVEAGATVATIEAMKMEASITAPVGGTVQRVALGGPQQVEGGDLVLVIGRG

SEQ ID NO: 250 - DNA, 3462 bp, Unknown
  pyc_5 sequence from unknown bacterial species from environmental sample
gtgttcgagaaggtgttggtcgccaaccggggtgagatcgcggtgcgggtgttccgggccgcgtacgagctgggcgcgcgcacggtcgcggtgttcccgcacgaggaccgggactcggtgcaccggctgaaggcggacgaggcatatctgatcggccaaccgggccatccggtgcgcgcgtacctcgacgttgacgagatcgtccgggtggcctcggcgtgcggtgcggacgcggtccacccgggctacggtttcctgtccgagaatccggagctggcgcgggcgtgtgcggcggcggggatcgcgttcgtcggcccgccgcccgaggtgctggagctgaccggcaacaaggtgcgggcggtggcggcggcccgggcggccggggtgccggtgttgcgctcgacgccgccctcgtcggaggtggatgagctggtcgtcgcggcggcggaggtcggctttccgatcttcgtcaaggcggtggccgggggtggcggccgcgggatgcgccgggtggacgcgccgggggagctgcccgatgcggtggccgccgcggtccgggaggctgaggcggcgttcggtgatccgaccgtgttctgcgagcaggcggtgctgcgcccgcggcacgtcgaggtgcaggtcctcgccgacgcggcgggggagatgatccacttgttcgagcgggactgctcggtgcagaggcggcaccagaaggtgatcgagatcgcgccggcgccgaacctggacgagccgatccggcgacggctgcacgcggacgcgctcgcgttcgcccgcgcggtcggctaccgcaacgccggcaccgtcgagttcctggtcggcaccgctggggatcgggccggcgagcatgtgttcatcgagatgaacccgcggatccaggtggagcacacggtcaccgaggaggtgaccgatgtggacctcgtgcaggcgcagctgcggatcgcggccggcgcgaccctgggcgacctgggattggcgcaggagacgatccactgtaacgggaccgccgtgcagacccggatcaccaccgaggatcccgcccacggctttcgcccggacaccggccggatcaccgcgtaccgctcgccgggtggggcgggggtccggctggacggcggtacggcacacgcgaacgccgagatcagcgcgcacttcgactcgatgctggtgaagctgacctgccggggccgcgacctgcgcaccgcggtgggccgggtccggcgggcgctggcggagttccggatccgcggggtcgcgaccaacctcccgttcctgcaggcggtgctggacgaggacgacttcctggccggccggctcactacctcctttatcgacgaacgtccccacctgctgcgggcgcgttccagcgccgaccgcggcacccggctgctgcggtggctggcggaggtcaccgtcaaccgcccgtacggcgacgccccggtcacggtcgacccggccgacaagttgccggcggtcggccaagtccggcgcctccactccgaccccgccgattgctccggccccggacaaggccgcgaggacccgaccggagcgccggccggcagccggcagcggctgcgcgagctcggcccggaagggttcgcccgggcgctacgcgaccaggccacggtcgcggtcaccgacacgaccttccgggacgcccaccagtcgttgctggcgacccgggtccggaccaaggacctgctggtggccgcaccgtacgtcgcgcaccggctggccgggttgtggagcctggaggcctggggcggcgccacctacgacgtcgcgctccggttcctgggcgaggacccgtgggagcggctggcggcgctgcgcgaggcggtgccgaacatcgcgctgcagatgctgctgcgcggccgcaacaccgtcggctacacgccctacccggagcaggtgacccgggcgttcgtggacgaggcggtcgccaccggcatcgacgtgttccggatcttcgatgcattgaacgacgtgggacagatgaccccggcgatcgaggcggtacgcgagtccggccgggcggtcgccgaggtggcgctgtgctacaccgctgacctgtccgacccgggcgagccgctctacaccctcgactactacctggcgctggccgagcggatcgtggcggcgggcgcgcacgtgctggcgatcaaggacatggccgggctgctgcgcccgccggcggcacggcggctggtcgccgcgctgcgcgagcggttcgacctgccggtccacctgcacacccacgacaccgccggcggccagctcgccaccctgctggcggcggtcgacgccggggtggacgcggtcgacgtggcctgcgcctcgatggccgggaccaccagccagccgccgatgtcggcactgctggcggcgctggcccataccgggcgcgcccccgggctggacctcgccgccgcccaggagtacgagccgtactgggaggccgtccgtcgggtgtatgcgccgttcgagtccggcctgcccggcccgaccgggcgcgtctaccggcacgagatccccggcgggcagctcagcaacctgcggcagcaggcgatcgcgctcgggctgggggagaagttcgagcagatcgaggacacctatgcggcgaccgaccggatcctcggccggctggtcaaggtcaccccgtccagcaaggtcgtcggcgacctggcgctgcatctggtcgcgctgggcgccgacgctgacgagttcgcccgcgacccggagcggttcgatatccccgactcggtgatcggcttcctcgccggcgagctcggtaccccgccgggcggctggccggagccgctgcgcacccgcgccctggcgggccgggagccgacttccggccgcgccgagctcgacgcgaccgacgcgaaggcgctcgccgaccccggaccgcagcggcgcgacaccctgaaccggctgctctttccgggcccgacccgcgagttcaccgaggtccggcagacctatggcgacctctcggtgctgggcaccgtcgactacctgtacgggttgcgccccggcgtggagtcgatcatcgagctggaacggggcgtccacctgatcgtccggctggaggcggtcggcgacgccgacgagcgcggcttccgtaccgtcatgtgcacgctcaacggccagctgcgcccggtgtgggtgcgcgaccggtcgatcgctgccgacgtaccggaggccgagaaggccgaccccgccaaccctcggcatctggccgtgccgttcgccggggtggtgaccgcggtggtggccgagggcgacgaggtcgaggcgggtcagaccgtcgccaccatcgaggccatgaagctggcggcctccatcacggcaccggtcggcggccgggtcgcccggctggcgatcaccggcccgcggcaggccgaggccggcgacctgatcgccgtcctggagcagtaa

SEQ ID NO: 251 - protein, 1153 aa, Unknown
  pyc_5 sequence from unknown bacterial species from environmental sample
VFEKVLVANRGEIAVRVFRAAYELGARTVAVFPHEDRDSVHRLKADEAYLIGQPGHPVRAYLDVDEIVRVASACGADAVHPGYGFLSENPELARACAAAGIAFVGPPPEVLELTGNKVRAVAAARAAGVPVLRSTPPSSEVDELVVAAAEVGFPIFVKAVAGGGGRGMRRVDAPGELPDAVAAAVREAEAAFGDPTVFCEQAVLRPRHVEVQVLADAAGEMIHLFERDCSVQRRHQKVIEIAPAPNLDEPIRRRLHADALAFARAVGYRNAGTVEFLVGTAGDRAGEHVFIEMNPRIQVEHTVTEEVTDVDLVQAQLRIAAGATLGDLGLAQETIHCNGTAVQTRITTEDPAHGFRPDTGRITAYRSPGGAGVRLDGGTAHANAEISAHFDSMLVKLTCRGRDLRTAVGRVRRALAEFRIRGVATNLPFLQAVLDEDDFLAGRLTTSFIDERPHLLRARSSADRGTRLLRWLAEVTVNRPYGDAPVTVDPADKLPAVGQVRRLHSDPADCSGPGQGREDPTGAPAGSRQRLRELGPEGFARALRDQATVAVTDTTFRDAHQSLLATRVRTKDLLVAAPYVAHRLAGLWSLEAWGGATYDVALRFLGEDPWERLAALREAVPNIALQMLLRGRNTVGYTPYPEQVTRAFVDEAVATGIDVFRIFDALNDVGQMTPAIEAVRESGRAVAEVALCYTADLSDPGEPLYTLDYYLALAERIVAAGAHVLAIKDMAGLLRPPAARRLVAALRERFDLPVHLHTHDTAGGQLATLLAAVDAGVDAVDVACASMAGTTSQPPMSALLAALAHTGRAPGLDLAAAQEYEPYWEAVRRVYAPFESGLPGPTGRVYRHEIPGGQLSNLRQQAIALGLGEKFEQIEDTYAATDRILGRLVKVTPSSKVVGDLALHLVALGADADEFARDPERFDIPDSVIGFLAGELGTPPGGWPEPLRTRALAGREPTSGRAELDATDAKALADPGPQRRDTLNRLLFPGPTREFTEVRQTYGDLSVLGTVDYLYGLRPGVESIIELERGVHLIVRLEAVGDADERGFRTVMCTLNGQLRPVWVRDRSIAADVPEAEKADPANPRHLAVPFAGVVTAVVAEGDEVEAGQTVATIEAMKLAASITAPVGGRVARLAITGPRQAEAGDLIAVLEQ

SEQ ID NO: 252 - DNA, 3450 bp, Unknown
  pyc_6 sequence from unknown bacterial species from environmental sample
ttgatctccaaggtgctggtcgccaaccgcggagagatcgccatccgcgcgtttcgcgccgcctacgagatggggctcgccaccgtcgcggtttatccggtcgaggaccgcaactcggtgcaccgcctgaaggccgatgaggcctatcagatcggccaacccgggcacccggtgcgggcctatctctcggttgacgagatcatgcgcgctgcggagatctccggcgccgatgtgatctatcctggttacggattcctttcggagaacccagaattggccgcggggtgtgaaactcgcgggttgacgtttgtcggtccgcccgctcggatactcgagctgacgggaaacaaggcgagggcgatcgccgcggcgaaggcagcggggctgcctgtcttgtccgcgaccgcgccgtccgacgatgtcgacgcgctcgtcgaggccgccggatcgatggccttcccggtattcgtgaaggccgttgcgggcggtggcgggcgcggtatgcgccgggtcagcgaatacgcgcagttgcgcgagtccatcgaagcagcggctcgggaggccgagtccgcgttcggtgaccccaccgtgttcctcgaacaagcggtgatcaacccgcggcacatcgaggtccagatactcgcggacaaccagggcaacgtcgtccatctgtacgagcgtgactgttcagtgcaacgccggcaccagaaggtcatcgagctcgcgcccgcccccaacctggatccggcgctgcgcgatcggatctgcgccgacgccgtggccttcgcccgggagatcggctactcgtgtgcagggacggtggagttcctcgtcgacgagaacggtcgacatgtattcatcgagatgaacccgcgcatccaggtcgagcacacggtcaccgaagagatcacggacgtcgacctcgtgcaggcccagatgcgcatcgccgccggggagtcgctgtcggagctgggcctcagccaggacacggtccggatccgcggcgcggctctgcaatgccgcattaccaccgaggatcccgagaacgagttccggccggacaccggacgtatcagcggataccgcactcccggcggagcgggcgtgcgactcgacggcggaaccatgctcggcgcccaggtcggagcgcacttcgattccttgctggtcaagttgacgtgccggggccgtgacttcgatgccgccgtcgccagggcgcggcgcggcgtggccgaattccgcatccgcggtgtggccaccaatattccgttcctgcaagcggttctcgacaatgaggatttccgagcgggcctggtcacgacgtcgttcatcgaaacccatccggggttgctcaatggctataacccggcgaaccgcggtagcaagatcttggcgtacctcgccgacgtgactgtcaacaagcctcacggcgaggccccggatatcagccacccgggcgacaagctgccgcccgtggatctgtcgaaaccgattcccgatggctcacggcagcgacttatggcgctgggcccgcaggccttcgcagatgcgctgcgccgccagcctgccctggcggtcaccgataccaccttccgcgacgctcaccaatccttgctggcgacgcggcttcgcacccatgaccttgttgccgtcgccgaccacatcgcgcgcactacaccgcagctgttctccgtcgaggcttggggcggcgcgacttacgatgtggcgcttcggcttctgcacgaggatccgtggcaacggttggctgaactacgagcggcgattcccaacatctgcctgcagatgctgctgcgaggacgcaacaccgttggttatacgccctaccccgaccaggtgacagaggcattcgtcgccgaagccgcggccacgggtgtcgacatcttccggatcttcgacgcgctcaacaacatcgaccagatgcgcccggctatcgacgccgtgcacacgacggggacggccgtcgctgaggtcgcgatgtcgtacaccggcgacctcagtgacccgaacgagcgcctctacacgctcgactactacctgcgtctggccgagcagttcgtcgaggcgggggcgcacatcctggcgatcaaggacatggcggggctgctgcgggcaccggcggccgcgaccttggtttccgcgctacgcaacaactttgaccttcctgtgcatgtgcacacccatgacacaccgggtggccaactcgcaacgtaccttgccgcctggcaggccggtgccgatgcggtcgatggcgccgcagcgccgctggcaggaaccacgagccagcccgcgctgtcggggatcgttgcggcaacggcgaatacaggtcgcgacaccgggatcgaactgcagtcgctgtgcgacctggaaccgtactgggagtcggtgcgacgcatctatgccccgttcgaggctggcctgcccgccccgaccggccgggtgtacacccacgagattcccggtgggcagctgtcgaacctgcggacccaggccgtggcgctggggcttggggagcggttcgaggacatcgaggccgcctatgcgggcgccgatcggctgctgggccgtttggtcaaggtcacgccgtcatcgaaggtggtcggcgatctcgcgctggccctcgtcggcgccggcgtcagtgccgaacggttcgcggccgagcctgcccgctacgacataccggactcggtgatcgggttcctgcgcggcgaactcggtgtgcccgtcggtggatggccagaacccttgcgtaccaaggcacttgagggccgcggggcggccaggccggaacaggtgctcactgccgaggaccgcacggcgctcggcgggttaccgcaggagcgtcgcgcggcgttgaaccggttgctgtttcccgggccgacccgggaattcaccgagcaccgggctcgctatggcgacacctcgctgctcgccagtccgcagttcttctacggcctgcgccaggacgaggagacgcaggtaacgctgagccccggggtgacgttgaacgtcggcctggaggcgatcgcggatgccgacgagcgcgggtaccgcacggtgatgtgtctgctgaacggccagctacggccaatccaagtgcgagacaactcgattgcgacggcgcaccccgccgccgagaaggccgaccgcgacgatccgcggcatgtcgcggcgccgttcgctggcacggtcactttgtcggtcggtgctggcgatcaggtaagcgcgggtgatccgatcgccaccatagaagcgatgaagatggaggccgccatcaccgcgcccgccgtcggcagggtgtcgcgcgtcgcaatcgacccgatcgcgcaggttgagggtggtgacttgctgctggtggtcgacgtcgaggacgctgtgaagggtgagcagcactcgaatcgcggcgccgaggtcgtcggtgtcggcagctga

SEQ ID NO: 253 - protein, 1149 aa, Unknown
  pyc_6 sequence from unknown bacterial species from environmental sample
LISKVLVANRGEIAIRAFRAAYEMGLATVAVYPVEDRNSVHRLKADEAYQIGQPGHPVRAYLSVDEIMRAAEISGADVIYPGYGFLSENPELAAGCETRGLTFVGPPARILELTGNKARAIAAAKAAGLPVLSATAPSDDVDALVEAAGSMAFPVFVKAVAGGGGRGMRRVSEYAQLRESIEAAAREAESAFGDPTVFLEQAVINPRHIEVQILADNQGNVVHLYERDCSVQRRHQKVIELAPAPNLDPALRDRICADAVAFAREIGYSCAGTVEFLVDENGRHVFIEMNPRIQVEHTVTEEITDVDLVQAQMRIAAGESLSELGLSQDTVRIRGAALQCRITTEDPENEFRPDTGRISGYRTPGGAGVRLDGGTMLGAQVGAHFDSLLVKLTCRGRDFDAAVARARRGVAEFRIRGVATNIPFLQAVLDNEDFRAGLVTTSFIETHPGLLNGYNPANRGSKILAYLADVTVNKPHGEAPDISHPGDKLPPVDLSKPIPDGSRQRLMALGPQAFADALRRQPALAVTDTTFRDAHQSLLATRLRTHDLVAVADHIARTTPQLFSVEAWGGATYDVALRLLHEDPWQRLAELRAAIPNICLQMLLRGRNTVGYTPYPDQVTEAFVAEAAATGVDIFRIFDALNNIDQMRPAIDAVHTTGTAVAEVAMSYTGDLSDPNERLYTLDYYLRLAEQFVEAGAHILAIKDMAGLLRAPAAATLVSALRNNFDLPVHVHTHDTPGGQLATYLAAWQAGADAVDGAAAPLAGTTSQPALSGIVAATANTGRDTGIELQSLCDLEPYWESVRRIYAPFEAGLPAPTGRVYTHEIPGGQLSNLRTQAVALGLGERFEDIEAAYAGADRLLGRLVKVTPSSKVVGDLALALVGAGVSAERFAAEPARYDIPDSVIGFLRGELGVPVGGWPEPLRTKALEGRGAARPEQVLTAEDRTALGGLPQERRAALNRLLFPGPTREFTEHRARYGDTSLLASPQFFYGLRQDEETQVTLSPGVTLNVGLEAIADADERGYRTVMCLLNGQLRPIQVRDNSIATAHPAAEKADRDDPRHVAAPFAGTVTLSVGAGDQVSAGDPIATIEAMKMEAAITAPAVGRVSRVAIDPIAQVEGGDLLLVVDVEDAVKGEQHSNRGAEVVGVGS

SEQ ID NO: 254 - DNA, 3414 bp, Unknown
  pyc_7 sequence from unknown bacterial species from environmental sample
atgcgaaagttgttggtcgcgaaccggggggagatcgcgattcgtgcgttccgcgctgcgttcgagctcgacctcgcgacggtcgcggtgttcgcgtgggaggaccgcgggtcgctgcaccgcctgaaagccgatgaggcgtacttgatcggtgagcgcggccacccggtgcgggcgtacctcgacgtggaccagatcgtgacaaccgcgttgtcgtgcggagccgatgcgatctacccgggctacggattcctatcggaaaaccccgggttggccgaggcatgcgagcatgccggtatcgcattcgtcggtccgaccgcagcggtactagcgatggccggcaacaaggtgcgcgcgattgaagtggcgcggcgcgctggcgttccgacgcttcgtagtgtgcatgcgcaggacaacgaaggtttggtcgccggcgcagagcagatcgatcttcctgtgttcgtcaaagcgcaagctggcggcggcggccgtggcatgcgtcgcgtcgacagtcgtgcggatctgctgccctacatcgaggcggcgcgccgtgaagcgctgtcagcgttcggtgacgcgtccgtatacatcgaggaggcggtcgttcggccgcgccacattgagatccagattctcggcgacgccacgggcgcggtggtccatctcttcgaacgcgactgctcggtacagcgccggcaccagaaggtggtcgagatcgcacccgcacctggccttgaccccgtgttgcgcgaccgtttgtgcgcagacgcggttcgcttcgcccagtcgatcggctacaccaacgcaggcacggtcgagtttctggttgccgacgatgggcgctacgcgttcatcgagatcaatccgcggatccaggtcgagcacaccgtcaccgaggaggtgaccgacgtcgatctcgtccacgcgcagatccggatcgcctcgggcgcaacactggccgagttgggtttgttgcaggacgacatcgttcagcgcggctgcgcgctccagtgtcgcatcacgaccgaggatccacacaacgacttccgtcctgacgcggggcgtatctccgcgtaccgcgctcccggcggcgcgggcgtacgcctcgacgcagcaagcggatacgtcggtgccgagatctccgcgtacttcgactcgctcctcgtcaagttgacatgtcgagggaatgatcgtcacagcgccgcagcgcgagcgcgacgcgccctcgcggagtttcgcatccggggcgtagccacaaacctcgcgttcctacagagcctcctcgcggatcctgacttcgtggctggtcgactccatacgtcgtttatcgaggaccgcccgtatctgctcaaggcacgagcggcagcggataggggcacgaaactgttaacctatcttgccgacgtgacggtcaacaagccgttcggtgacgcccccagccgcatagacccgcgctcgaagctgcctctagcgaccgactacgacgaagcagcgacgccaggtagtcgtcaactccttgcagaactcggtccacaagcattcgcagctcgtctgcgcacccaggcagcaaccgcagtgaccgacaccacctttcgcgatgcgcaccagtcattgctcgccacccgacttcgcacgtatgacatgttggcggccgccccgaccgtggcgagaacgcttcctcagctgctgagtctcgaagcttggggcggcgcgacctatgacgtcgcgctgcggtttctaaaggaagacccgtgggagcgactcgacgccctacgagaaacggtgccgaacatctgcctgcaaatgctgctgcgcggcgccaacactgtcggctacggaccgtcgccgccctcgacgacgaaacgattcgttcaggaggcggcgcgcagcggaatcgatatcttccgcatcttcgacgctctcaacgacgtaaaccagatgcgagccgcaatcgacgctgtcctcgaaaccgacgcgctcgtcgaggcatgcctgtgctacacgggcgacctcggcgagcctaccgagaacctctacaccctcgactactacctcgcagtcgccgagcggctcgtcgccaccggcgcgcacgtgatcgccatcaaggacatggcgggtctgttgcgccctccggctgcacgtactctcgtatcggcactacgcgcactgttcgacgcaccaatccacgtacacacccatgacaccgcgggcgggcaactcgctacgtacctcgcagctgttgacgctggagccgacgccatcgacggcgccattgctcccttcgcaggcacgacgagccagccatccctcgcggcgatcgtcgctgccaccgaccacacgccacgtgcgaccggtctctccctcgatgcgctcatcgatctcgagccatattgggacgccgttcgcgaccactaccgaccattcgacgaagcccttcgcgccccgaccggcgcggtttaccgtcacgagattccaggcggccaactcacgaacctgcgccagcaagccatcgcgctcggattcgggcaccgcttcgaagacgtccagcgttggtatacgacggtcaaccacctcctcggcaacatcatcaaggtcacacccacgagcaaggtcgttggcgatctcgccatcgccttgtgcgggaccggcctcacccccgaggaattcgagaccgatccgagccgcgtcgacatacccgacagcgtggtcgcgtttctccaaggcgcgctcggcgagccgcccggaggatggcgcgagccgttcagaacgcgcgcactcgctggtcgcacgcgcatcacagactcaactcccgaggatgcggaaacgctcccaccgccgggccccgactgccgcgtggcaatcagccaggagttgttcccggacccggccaccgacttcgaacaaacccgaaccctctacggcgacctctccgtgctcccaagcagtctgttcttctacggtctgcgaccaggcgaagagtttgacgtccgcctcggccccggcgtcgacttgatcatcggcctcgaagcaatcgccgaacccgacgcgcgcggtatgcgcaccgtgctctgccgcatcaacggacaggtccgacccatcgtggtccgcgaccaccaggccaactccaccgccgcaactgctgaacgcgcaaatccgcaaactccaggccacgtcgcggcgccctacgatggcgtcgtcaccgtccgcgtcaccgcgggtcaagtagtgaccgctggtgaccctgttgccagcatcgaggctatgaagatggaaagcaccatcaccgcgcccatctcaggaaccgtcgaacgcatcgcaatcagcccaatcggacacgtacaagcaggcgacctcatcctcacgatcaaacccgcatcgctcgcctccccacatgttgaaccgaccgcgctctaa

SEQ ID NO: 255 - protein, 1137 aa, Unknown
  pyc_7 sequence from unknown bacterial species from environmental sample
MRKLLVANRGEIAIRAFRAAFELDLATVAVFAWEDRGSLHRLKADEAYLIGERGHPVRAYLDVDQIVTTALSCGADAIYPGYGFLSENPGLAEACEHAGIAFVGPTAAVLAMAGNKVRAIEVARRAGVPTLRSVHAQDNEGLVAGAEQIDLPVFVKAQAGGGGRGMRRVDSRADLLPYIEAARREALSAFGDASVYIEEAVVRPRHIEIQILGDATGAVVHLFERDCSVQRRHQKVVEIAPAPGLDPVLRDRLCADAVRFAQSIGYTNAGTVEFLVADDGRYAFIEINPRIQVEHTVTEEVTDVDLVHAQIRIASGATLAELGLLQDDIVQRGCALQCRITTEDPHNDFRPDAGRISAYRAPGGAGVRLDAASGYVGAEISAYFDSLLVKLTCRGNDRHSAAARARRALAEFRIRGVATNLAFLQSLLADPDFVAGRLHTSFIEDRPYLLKARAAADRGTKLLTYLADVTVNKPFGDAPSRIDPRSKLPLATDYDEAATPGSRQLLAELGPQAFAARLRTQAATAVTDTTFRDAHQSLLATRLRTYDMLAAAPTVARTLPQLLSLEAWGGATYDVALRFLKEDPWERLDALRETVPNICLQMLLRGANTVGYGPSPPSTTKRFVQEAARSGIDIFRIFDALNDVNQMRAAIDAVLETDALVEACLCYTGDLGEPTENLYTLDYYLAVAERLVATGAHVIAIKDMAGLLRPPAARTLVSALRALFDAPIHVHTHDTAGGQLATYLAAVDAGADAIDGAIAPFAGTTSQPSLAAIVAATDHTPRATGLSLDALIDLEPYWDAVRDHYRPFDEALRAPTGAVYRHEIPGGQLTNLRQQAIALGFGHRFEDVQRWYTTVNHLLGNIIKVTPTSKVVGDLAIALCGTGLTPEEFETDPSRVDIPDSVVAFLQGALGEPPGGWREPFRTRALAGRTRITDSTPEDAETLPPPGPDCRVAISQELFPDPATDFEQTRTLYGDLSVLPSSLFFYGLRPGEEFDVRLGPGVDLIIGLEAIAEPDARGMRTVLCRINGQVRPIVVRDHQANSTAATAERANPQTPGHVAAPYDGVVTVRVTAGQVVTAGDPVASIEAMKMESTITAPISGTVERIAISPIGHVQAGDLILTIKPASLASPHVEPTAL

SEQ ID NO: 256 - DNA, 3387 bp, Unknown
  pyc_8 sequence from unknown bacterial species from environmental sample
gtgcgtaccgtgctggtcgccaaccgcggcgagatcgccatccgggcgttccgggccgcggtcgagctgggtctgcagacggtcgcgatctacacccacctcgaccgcgggtcggtgcaccgcatcaaggccgaccgggcctacgaggtcggcccgcccgagcgcccgctggcgggctacctcgatgtcggcgctattgtcgaggcggcggtcgccagcggcgccgacgccgtctacccggggtacgggttcctctccgagagtgcggccttcgcggccgcatgccgcgacgccggcctgacatggatcggcccacctcccgaggtgctggcgctcaccggcgacaaggtgcgcgcgcgggaggcggccgtcgccgccgggctgccggtgcttgccgcgtcgccaccggtcgacgagcacgacgcccccgagcaggccgaaggcctgggctacccggtgttcgtcaaggccgccgctgggggtggcggacgcgggctgcgcgtcgtgcggcgcgcgcaggacctcgtcgccgcagtctcgacggcccgccgcgaggccgaggcggcgttcggcgacccgaccgtgttcctggagcgcgccctcgagcggccgcgccacgtcgaggtgcagattctcggcgacgccaccggcggtctcgtccacctgggcgagcgcgactgctcgatccagcgccgccaccagaaagtcgtcgagcttgcgccggcgccgaacctcgaccctggcgtccgcgaccagctgcatgccgatgccgtcgcgctcgggcaggccgttggttacgtcaacgccggcaccgtcgagttcctcgtcgccgaggacggcagtcacatcttcctggaggtcaacccgcggatccaggtcgagcacacggtgaccgaggaggtcaccggcgtcgacctcgtcgcggcgcagctgcgcatcgccgacggcgcgtcgctcgcggacctgggtatcgcgcaggagtcggtgcgctggcagggcgtcgcgatccaatgccggatcacgaccgaggacccggcgacggggttccggcccgacaccggcacggtgatggcctaccgctcgcctggcggcgctggcgtgcggctggacggcggtgcgatcgatctcggcagcgagatcacgccgtggttcgactcgctgctggtgaagctgacctgccgcgggcccgacctcgacacggccgcgcgtcgcgcgcgccgggcgctcgcggagttccgcgtgcgcggcctcgccaccaacatcgcgttcctgcaggcgctgctgtcggagccggacctgctcgaggggcgcctgtcgaccgcgttcctcgacgagcaccctcacctgctgcacgccccgggcgggcacgaccgggtgtcgaagctgctctcctacgtcgcggacgtgaccgtgaaccggccccatgggcgggcgcctgcgtccgtcgacccggtgtcgctcctgcccgcaccgccggagtggccgccgccggagggctcgaagcaactgctggaccgtctgggcgcggaggggttcgcaaggtggaccgcggagcagccgtcgaccggcgtcaccgataccaccatgcgcgacgcgcaccagtcgctgatcgcgacccggatgcgcaccgccgacatggtcgcggcggcacgccacgtcgccgcgatgctgccgcagctgtggagcatggaggtgtggggcggtgcgatccacgacgtatcgcttcgcttcctgctggaggatccgtggcagcggctggcagcgctgcgtgaggcgatccccaacatctgcctacagatgctgctgcgcgggcggaacctggtcggctacggcagtgtcgacgacgcggtcgtgcgcgcgttcgtggacgaggcggcgaagaccggcatcgacgtgttccgcatcttcgacgccttcaacgacgtcgagcggatgcgccccgccatcgatgcggtccgtacgacgcacgcggtcgccgaggcggtcgtctgctacacggctcacgccgtcgacccgcgcgagcggctgtacacggtgtcctactacgccgacatcgcggcgcggctcgcggccgcgggcgcacacaccctcgcgatcaaggacatggcggggctgctgcgcgcgggcgcggccaccgcgctggtacgagcggtgcgcgacgccaccgggctgccggtgcacatccacacgcacgacacggcgggcgggcagctcgccacctatctcgccgcggtcggggcgggcgcatcggtggtggacgccgcggccgcgccatggtcgggcggcaccagccagccgtcgctgagcgcgctgatcgcggcgctggatgccaccgactccccgacggcgctgtcgctggacgcggcgttggacctggagccgtactgggaggcggtccggcggctctacgcgccgttcgaccaggggatccccgcgccgagcggcgcggtctaccgccatgagatcccgggcggccagctgtcgaacctgcgccagcaggccgcggcgctgggcctggcggagcggttcgacgagatcggtcgggtgtaccagcgggtcgatcggatgctcgggcggctcgtcaaggtgacgccgtcgagcaaggtggtcggcgacctcgcgctgtacctgatctcggccggcatcgacccggacgccttggaggccgaccccggtgcgtacgacgtgcccgcgtcggtgatccggttcctgcaaggtgatctcggcaccccgccaggtgggtgggcggagccgttccgcagcctggcgctagcgcggcacggcgcggcccaggcgccgtccgatgcaggccccgccgtcgaccacgccgcgctggaggccacctccgccaatcgccgcgacgccctcaacgccagtcagttcccggcggaggcgcgcgagcgcaaggaggcggtcgagcgctacgccgacgtgtcggtgctgccgacgcgcacgttcttctacggcctcgacccgctcgaggagatcgtcgtggaactggaacccggcgtgcgcgtcttcctcgacctggacgccgtcggcgaggccgacgacaagggtcgccgcaccgtggtgatgcgggtcaacggccaactgcgcgccgtgaccgcgcacgaccgttcggtcgcccccgccgacgcgcccgccgagcgtgcggacccgagcagcccgggagatatcgccgccccgttgaccggcatcgtcaccgtgctcgtcgccgacggcgaacaggtgcaggcgggcgcgcgcctgtgcgcgctggaggcgatgaagatggagtcgacggtcactgcgccgttcgccggccgcgttgctcgtgtggtggcgagcaacggcgcccgcgtcgagcccggcgacctgctcgtcgtcctcgagcccgacgagtga

SEQ ID NO: 257 - protein, 1128 aa, Unknown
  pyc_8 sequence from unknown bacterial species from environmental sample
VRTVLVANRGEIAIRAFRAAVELGLQTVAIYTHLDRGSVHRIKADRAYEVGPPERPLAGYLDVGAIVEAAVASGADAVYPGYGFLSESAAFAAACRDAGLTWIGPPPEVLALTGDKVRAREAAVAAGLPVLAASPPVDEHDAPEQAEGLGYPVFVKAAAGGGGRGLRVVRRAQDLVAAVSTARREAEAAFGDPTVFLERALERPRHVEVQILGDATGGLVHLGERDCSIQRRHQKVVELAPAPNLDPGVRDQLHADAVALGQAVGYVNAGTVEFLVAEDGSHIFLEVNPRIQVEHTVTEEVTGVDLVAAQLRIADGASLADLGIAQESVRWQGVAIQCRITTEDPATGFRPDTGTVMAYRSPGGAGVRLDGGAIDLGSEITPWFDSLLVKLTCRGPDLDTAARRARRALAEFRVRGLATNIAFLQALLSEPDLLEGRLSTAFLDEHPHLLHAPGGHDRVSKLLSYVADVTVNRPHGRAPASVDPVSLLPAPPEWPPPEGSKQLLDRLGAEGFARWTAEQPSTGVTDTTMRDAHQSLIATRMRTADMVAAARHVAAMLPQLWSMEVWGGAIHDVSLRFLLEDPWQRLAALREAIPNICLQMLLRGRNLVGYGSVDDAVVRAFVDEAAKTGIDVFRIFDAFNDVERMRPAIDAVRTTHAVAEAVVCYTAHAVDPRERLYTVSYYADIAARLAAAGAHTLAIKDMAGLLRAGAATALVRAVRDATGLPVHIHTHDTAGGQLATYLAAVGAGASVVDAAAAPWSGGTSQPSLSALIAALDATDSPTALSLDAALDLEPYWEAVRRLYAPFDQGIPAPSGAVYRHEIPGGQLSNLRQQAAALGLAERFDEIGRVYQRVDRMLGRLVKVTPSSKVVGDLALYLISAGIDPDALEADPGAYDVPASVIRFLQGDLGTPPGGWAEPFRSLALARHGAAQAPSDAGPAVDHAALEATSANRRDALNASQFPAEARERKEAVERYADVSVLPTRTFFYGLDPLEEIVVELEPGVRVFLDLDAVGEADDKGRRTVVMRVNGQLRAVTAHDRSVAPADAPAERADPSSPGDIAAPLTGIVTVLVADGEQVQAGARLCALEAMKMESTVTAPFAGRVARVVASNGARVEPGDLLVVLEPDE

SEQ ID NO: 258 - DNA, 3456 bp, Unknown
  pyc_9 sequence from unknown bacterial species from environmental sample
atgcgcaaactgctcgtcgccaaccgctctgagattgcgatccgctgtttcagggcggcgaccgaactcggcctccggaccgtcgccatctacagccacgaggatcgattctcactacatcgcttcaaggcagacgaagcattcctgatcggtccgccgggcggcggcgagccggtacgctcgtatctgaacatccccgcgatcatcgccattgctcatcagcagagcgtcgatgcgattcatccgggctacggattcctcgccgagagcgccgacctcgcgcgcgcgtgcgaggcggccggcattcaattcgtcgggccgacgcccgagcatctcgatatgtttggcgacaagaccgccgccaagcgtctggcggtcgccgccggcgtgccgactgtgcccggctccgagggcgctctccaggaccttggcgacatctcggcggcggccgccaaagtgagttatcccctgatgatcaaggcgagcttcggcggcggcggccgaggcatgcgcatcgtcaggacgcccgacgagctcgccaacaagctcgaggaggcgcagcgggaagcgggcgcggcgttcgggcgaccggacgtgtttctcgagcggtacataccgcgcgccaagcacatcgaggtgcagatcctcggtgatgcccacggcgctctggttcatctctgggagcgcgactgctccgtacagcgccggcatcagaaagtcgtcgagctcgcgccgagcatcaatgtggccgagagcctgcgtcagcagatctgcgacgctgccgtgcgcttgtgccggtcagtcaactatcgcaatgccggcaccgtcgagttcctgctggatgtcgagcgcggtgagttctacttcatcgaggtaaacccgcgcattcaggtcgagcacacggtcaccgaggtcgtcacggggatcgatctggtccgcagtcagatcctgatcgccgacggccatcgcctgcatgaggccccgctcaacgtccccgcccaggaggagatccgcacgcgcggtgtcgccatgcagtgccggatcacaaccgaagatccggaccgccatttcatccccgactacgggcgcatcaccacgtatcgatcggccggcggcttcgcggtgcggctcgatgggggcaacgggttcggcggctccgtcatcacgcccttcttcgattcgctgctcgtgaaagtgacgacgtggggcggcacgctcgaggaatcggcgcagcgcgctgaccgcgcgctccgcgagttccgtattcgcggcgtcaagacgaacatcgcgtttctgttgaatctgattggtcacccgacgttcaggtcgggcgccgccaccacgaccttcatcgacgagacgccggagctcttccggattcaggccccacgggatcgcgccacgaaaatgctcgggtacttgggcgacgtgatcgtgaacggccgaccagacgtcaagaacgcgtacgacccccaacgcaagctgccgacccagaagccaccggttgtgccgccaatggccgcccccccagctggaatgcgccagaagcttcaagagcttgggccggagcgcttcgcctcgtgggtgcggggtgaacgtcgtctgctcatgaccgacacgacgttccgcgatgcgcaccagtcgttgctcgcgacacgcgtacggacgtacgacatgctggcgatcgccgacgccgtggcgcggttgatgccggatctgttcagcctggagatgtggggaggtgcgacgttcgacacctcgatgcgcttcctccaggaagacccgtgggccaggctcattcagctgcgcgagcgcatcccgaacatcctgtttcagatgctgctccgcggcagcaacgcggtcggctacaccacctatcccgacaacgtggttcgcgccttcgtgaagcggagcgcggaggccggcatcgacgtattccggatcttcgacgcgctgaactccaccgacaacatgcgtgtcgcgatcgaggccgtccgcgaggacacgacggcgatctgcgaggccgccatctgctacacgggcgatatcctcgatccgaacagaaccaagtactccctggattactacctgcggatcgcgaagaagctcgtggccatgggcacgcacatcctctgcatcaaggacatggccgggttgtgcaaaccctacgcggcccacgcgctgattcaggcgctgcgcgaggaagtggacgtcccgatccatttccacacgcatgacacgagcggagtgaacgccggcagcattctgcgcgcatccgacgccggagtggacattgccgacgctgcgatcgcctcgatgagcgggatgacgagccagccgagtctgaacggcgtcgttgcagcgctccgccatacggagcgcgacaccgcactgaatcaggaagcgctcgacgagctgagccgctactgggccgacgtgcgggaactctattacccgttcgaagaagggttgaaagcgcctcaggccgatgtctatcaacacgagatgcccgggggtcagttcacaaaccttcgtcagcaggcccgcaaccttggatttggcgatcgctggcccgagatctccgcggcctatgcagaagccaatcggctggccggcgatatcgtgaaggtgaccccttccagcaaggtcatcggcgatctggcgctcttcatggtcacgaacaacctgaccgccaacgacatcctgacgtccggcgcgcccctgagtttcccgcgcagcgtcgtcggcatgatgcagggactgctcggccagcccgagggcggctggccgaaagactttcaggagatcgtgctgcgttcggcgcacgcaacgcctatcacgggccgccccgcggatactctgccgccagctgacttcgaggccaccgcgcaggagctcaaggctaagacaggacgcgatgtcagcgagcacgacgtgctctcgtacttgctgtatccgcaggtgtatgtcgagtacatcgagcactggcagaagtacggcgacacctcgacgattccgacagcgaatttcttctacggattgcagccaggggaggagaccgcgatcgagatcgagcgcggcaagacgttgttcgtccgctttctgacggctggagaggtgcgcgaggacggcacgcgaacggtgttcttcgagctgaacggacagccgcgagaggtgcgtgtcatcgatcgttcagtgaccgccctccgcaagagccatcccaaggccgacgttgaaaatcccgatcatgtcgctgcgccgatgccgggaaagatctcgtcggtcgcggtacggccaggccaaagggtgcgagcgggtgaccgtctgctttcgatcgaagcgatgaaaatggagacagccgtatatagtccacgcgatggggccgtggcagaggtgctggtcgtcacgggccaggttgtcgaaacccgggatctgctgcttgtcctgactgagtga

SEQ ID NO: 259 - protein, 1151 aa, Unknown
  pyc_9 sequence from unknown bacterial species from environmental sample
MRKLLVANRSEIAIRCFRAATELGLRTVAIYSHEDRFSLHRFKADEAFLIGPPGGGEPVRSYLNIPAIIAIAHQQSVDAIHPGYGFLAESADLARACEAAGIQFVGPTPEHLDMFGDKTAAKRLAVAAGVPTVPGSEGALQDLGDISAAAAKVSYPLMIKASFGGGGRGMRIVRTPDELANKLEEAQREAGAAFGRPDVFLERYIPRAKHIEVQILGDAHGALVHLWERDCSVQRRHQKVVELAPSINVAESLRQQICDAAVRLCRSVNYRNAGTVEFLLDVERGEFYFIEVNPRIQVEHTVTEVVTGIDLVRSQILIADGHRLHEAPLNVPAQEEIRTRGVAMQCRITTEDPDRHFIPDYGRITTYRSAGGFAVRLDGGNGFGGSVITPFFDSLLVKVTTWGGTLEESAQRADRALREFRIRGVKTNIAFLLNLIGHPTFRSGAATTTFIDETPELFRIQAPRDRATKMLGYLGDVIVNGRPDVKNAYDPQRKLPTQKPPVVPPMAAPPAGMRQKLQELGPERFASWVRGERRLLMTDTTFRDAHQSLLATRVRTYDMLAIADAVARLMPDLFSLEMWGGATFDTSMRFLQEDPWARLIQLRERIPNILFQMLLRGSNAVGYTTYPDNVVRAFVKRSAEAGIDVFRIFDALNSTDNMRVAIEAVREDTTAICEAAICYTGDILDPNRTKYSLDYYLRIAKKLVAMGTHILCIKDMAGLCKPYAAHALIQALREEVDVPIHFHTHDTSGVNAGSILRASDAGVDIADAAIASMSGMTSQPSLNGVVAALRHTERDTALNQEALDELSRYWADVRELYYPFEEGLKAPQADVYQHEMPGGQFTNLRQQARNLGFGDRWPEISAAYAEANRLAGDIVKVTPSSKVIGDLALFMVTNNLTANDILTSGAPLSFPRSVVGMMQGLLGQPEGGWPKDFQEIVLRSAHATPITGRPADTLPPADFEATAQELKAKTGRDVSEHDVLSYLLYPQVYVEYIEHWQKYGDTSTIPTANFFYGLQPGEETAIEIERGKTLFVRFLTAGEVREDGTRTVFFELNGQPREVRVIDRSVTALRKSHPKADVENPDHVAAPMPGKISSVAVRPGQRVRAGDRLLSIEAMKMETAVYSPRDGAVAEVLVVTGQVVETRDLLLVLTE

SEQ ID NO: 260 - DNA, 3459 bp, Unknown
  pyc_10 sequence from unknown bacterial species from environmental sample
atggccatgtccatccgccccccccctgccttcaagcgcatcctggtcgccaaccgcagcgagatcgccatccgggtctttcgcgcctgcaccgagctcggcatccgcaccctcggcatcttcagcaaggaagaccgcacggctctgcatcgctacaaggcggacgagacctacgcgctggacgagcggctcgagcccatcaaggcctacctcgacatccccggcatcatcaacatcgccaaacgccacggcgccgacgccatccaccccggctacggcttcctctccgagaacgcggccttcgcgcgcgcctgcgaggaagcgggcatcgtcttcattggcccgccccccgcgctgctcgacatgatgggcgacaaaaccgccgcccggaaacaagcccaagaggtgggcctgccggtggtgcccggcaccgacgccccggtgcccagccccgaggacgcggtcaccatcgccggccgcatcggctacccggtgatcctcaaagcctcctacggcggcggcggccgcggcatgcgcgtggcgcgcaccgacgccgagctgcgcgagtttttcacccaggccgaacgcgaagccaccgccgctttcggccgcggcgagatcttcctcgagaagttcatcgagagccccaaacacatcgaggtgcagatcctggccgaccagcacggccacaccgtgcacctttacgagcgcgactgctcggtccagcgccgccaccagaaggtggtggagatcgccccctccccgcacctcgacgacaagctgcgcgccaccctgtgcgacgaggccgtgcgcctgtgccaggcggtgggctacgtcaacgccggcacggtggagttcctggtcgacaaacacggcgcccattacttcatcgagatgaacccccgggtgcaggtggaacacaccgtcaccgagatggtcaccggcatcgacatcgtcaaatcgcagatccgcatcgccgagggccaccccctggaaagccccctcatcggcatccccgcccaaagcgcggtcagcctgcgcggctacgccatccagtgccgcataaccaccgaggatcccgccaacaacttcatccccgactacggccgcatctcgcactaccgctcggcggccggcttcggcatccgcctcgacgccggcaccgccttttccggtgccctcatcaccccgttttacgactcgctgctggtcaaggtctgcgcctcgggcctcaccttcgacgaggcctgcagcaagatggaccgcgccctggccgagtggcgcgtgcgcggcgtgcgcaccaacctgcccttcctgcgcaacgtggtcaatcacccgcgctttcgcgccggcgacgccaccaccaccttcatcgccgacacacccgagctgctggtgttccaagagcgcttcgatcgcgccaccaagatcctgcagttcatcggcgacgtcagcgtgaacggcaaccccgaggtcaagggcgcgcggcccgagaagctgcgcaagccggtggtgcccgaacacgagccccaccaggcccccccgcccggcacccgcgatctgtggaagaagctcggcaccgcggacttctgcgcctgggtgcgcgatcagaagaagctgctgctcaccgacaccaccttccgcgacgcccaccagtcgctcttcgccacccgcctgcgcacgctggagatgacccgggtggcgcccgcggtggcccagcacctctccggcctgttctcgctggagatgtggggcggcgccaccttcgacgtggccatgcgctttttgcacgaggatccctgggaccgcctggccaccttgcgcaagcagatccccaacgtgctcttccagatgctcctgcgcggggcgaacgcggtcggctacaccaactaccccgacaatgtcgtgcgccgcttcgtcgaggaagccgcccgcaccggcatggacatcttccgcatcttcgattcgctcaactggctgcccggcatcctgcccgccatcgagatggtggccagcgccggcggcatcgccgaagcctccctctgttacaccggcaacatcgacgaccccaaacgttcgaagtacgacctcaagtactacgtcgatctggccaaggagctggagaaacacggcgcccacatgctgggcatcaaggacatgtcgggcctcttgcgccccttcgccgcccgccgcctgatccgggccctgcgcgaggaagtgggcctgcccatccacctgcacacccacgacaccgccggcatccaagccggctcctatctgttcgccgccgaggccggggtcaacgtggtcgactgcgcgttcggcgccatgtccagcctcacctcgcagcccaacctcgagagcatcgtggccgccctcgagcaccaggagcgcgacaccggcctcgacttcacccggctgctggacttcacctactactgggaagaggtccgcaactactacgccgccttcgaaagcggcatgaagtcaccttccgccgacgtctacgtgcacgagatccccggcggtcagtacagcaacctgcgcccgcaggccgaatcagtgggggtgggggatcgcatccccgagctcaagcgcatgtacgccgtggtcaacgagatgctgggggacatcgtcaaggtgacgcccagctcgaagatggtgggcgatctggccctcttcatgttgaccaacaatctcactccgccggacctgatcgagcgcggacgcgagctgaccttccccgagtcggtgatcggctacttcgccggcgaaatcggccagccgcccggcggttttcccccggcgctgtccgcggccatcctcaagggccgcacgcccttcgccggccgcccgggcgacaccctgccgccggtggacttcgacaagacccggcgcgaggtggaaaccaaagtgggccgtcccgccagcgagcaggacgtgctgtcctatctgatgtaccccaaggtcttcaccgactttgccagctatgtgaaaaagtacggtgacgtctcggcggtgcccaccgatgtgatgttctatggcatgcgcaagggcgacgagaccgaggtggagatcgaacggggcaagaccctgttcatccgcctcggcgccatcagcgagcccaacgaacgcggcatgcgcaccttgttcttcgagctgaacgggcacccccgcgaggtcgaggtgctggacaagaagctgggcaaggcggtggcggcccgccccaaggccgacaaggacaacctgcaccacctcggctcacccatgcccggcaccgtcatcgaggtgaaggccaaggcgggcgacgaggtcaaggaaggcgacaagctggtggtgctggaagcgatgaagatggagatgacgctggcctcgccgctggccggcgtcatcaaggaaatcaccgtcaccccgaaggaccgtgtcgataccggggatctgctggtggtattcaagtag

SEQ ID NO: 261 - protein, 1152 aa, Unknown
  pyc_10 sequence from unknown bacterial species from environmental sample
MAMSIRPPPAFKRILVANRSEIAIRVFRACTELGIRTLGIFSKEDRTALHRYKADETYALDERLEPIKAYLDIPGIINIAKRHGADAIHPGYGFLSENAAFARACEEAGIVFIGPPPALLDMMGDKTAARKQAQEVGLPVVPGTDAPVPSPEDAVTIAGRIGYPVILKASYGGGGRGMRVARTDAELREFFTQAEREATAAFGRGEIFLEKFIESPKHIEVQILADQHGHTVHLYERDCSVQRRHQKVVEIAPSPHLDDKLRATLCDEAVRLCQAVGYVNAGTVEFLVDKHGAHYFIEMNPRVQVEHTVTEMVTGIDIVKSQIRIAEGHPLESPLIGIPAQSAVSLRGYAIQCRITTEDPANNFIPDYGRISHYRSAAGFGIRLDAGTAFSGALITPFYDSLLVKVCASGLTFDEACSKMDRALAEWRVRGVRTNLPFLRNVVNHPRFRAGDATTTFIADTPELLVFQERFDRATKILQFIGDVSVNGNPEVKGARPEKLRKPVVPEHEPHQAPPPGTRDLWKKLGTADFCAWVRDQKKLLLTDTTFRDAHQSLFATRLRTLEMTRVAPAVAQHLSGLFSLEMWGGATFDVAMRFLHEDPWDRLATLRKQIPNVLFQMLLRGANAVGYTNYPDNVVRRFVEEAARTGMDIFRIFDSLNWLPGILPAIEMVASAGGIAEASLCYTGNIDDPKRSKYDLKYYVDLAKELEKHGAHMLGIKDMSGLLRPFAARRLIRALREEVGLPIHLHTHDTAGIQAGSYLFAAEAGVNVVDCAFGAMSSLTSQPNLESIVAALEHQERDTGLDFTRLLDFTYYWEEVRNYYAAFESGMKSPSADVYVHEIPGGQYSNLRPQAESVGVGDRIPELKRMYAVVNEMLGDIVKVTPSSKMVGDLALFMLTNNLTPPDLIERGRELTFPESVIGYFAGEIGQPPGGFPPALSAAILKGRTPFAGRPGDTLPPVDFDKTRREVETKVGRPASEQDVLSYLMYPKVFTDFASYVKKYGDVSAVPTDVMFYGMRKGDETEVEIERGKTLFIRLGAISEPNERGMRTLFFELNGHPREVEVLDKKLGKAVAARPKADKDNLHHLGSPMPGTVIEVKAKAGDEVKEGDKLVVLEAMKMEMTLASPLAGVIKEITVTPKDRVDTGDLLVVFK

SEQ ID NO: 262 - DNA, 3393 bp, Unknown
  pyc_11 sequence from unknown bacterial species from environmental sample
atgccggtcagggagtcgctcgtgcgcaaggtcctcgtcgccaaccgcagtgagatcgcggtccgcgtcatgcgcgcggcccacgagatggacctgctgaccgtcggggtctacacgcccgaggaccgcggggcgctgcaccgcaccaaggcgggcgaggcctaccagctgggcgagccgggccaccccgtgcgcggctacctcgacgtcgaggcgctgctcgaggtcgcccgccgctccggcgccgacgcgctgcaccccggctacggcttcctgtccgagagcgccgcgctcgccgacgcctgcgcctcggctggcatcaccttcgtcgggccgccggcggacgtgctgcgcctgaccggtgacaaggtcaccgcccgccaggcggcggtggccgcgggcctgccggtgctgcgcgcctccgacccgctgccggacgggtccggggcgatcgaggcggccgaggcggtgggcttcccgctgttcgtcaaggcggcggccggcggcggcggccgcggcctgcggctcgtgcggacgcccgaggagctcgccgacgcggcgctgtcggcgtcgagggaggcggccgcggccttcggcgacgggacgatcttcctcgagcaggcggtcgagcggccgcgccacatcgaggtgcaggtgctcggcgacacgcacggctcggtggtccacctgttcgagcgcgactgctcggtgcagcggcgccaccagaaggtcgtcgagctcgcgccggcgcccgacctgccggaggccacgcgcacgggcctgcacgaggcggccctcgcgttcgcccgttcggtcggctacgtcaacgccgggacggtggagttcctcgtgggcgccgacggggcgttcacgttcatggagatgaacccccgcatccaggtcgagcacaccgtcaccgaggaggtcaccggcgtcgacctcgtcggcgcccagctgcgggtggccgcgggggagtcgctcgccgacatcggcatcgtgcaggagcgcctggcggtccgcggctgcgccgtccagtgccgcatcaccaccgaggacccggccaacggcttccgcccggacaccggcacgatcgcgacctaccagtcgcccggcggcccgggcgtgcgcctcgacggcgcggtctacgccggcgccgaggtcacgccgtacttcgactccctgctcgtcaagctcacgacccgcgcccccgacctgcgcaccgccgccaaccgcacccggcgggcgctgcgggagttccgcgtgcgcggggtgaagaccaacgtcgagttcctctaccgcctcatggaggacgaggacttcctgtccggcgcggtgccgacgtcgttcctcgccgagcacccgcacctcacggacgcgcccgcggtcaccgaccggacgacccggatgctcggcgcgctggccgacgcgacggtgaacgggctgcagcgcccgtcgcgcccgctgctcgacccggtcagcaagctccccgacctgcccgccgccccgccggtgcagggctcgcggcgcctgctcgacgaggtcggcccggagcgctgggcgcaggccctgcgcgaccgcacgtccctcgcggtgaccgacacgacgctgcgcgacgcccaccagtcgctgctggccacccggctgcggaccaccgacgtcctcggcgccgcgccgaggacggcggagctgctgcccggcctgctgtcgctcgaggcgtggggcggcgcgacgtacgacgtggcgctgcgcttcctgcacgaggacccctggcagcggctcgccgcgctgcgcgaggccgcgcccgacgtctgcctgcagatgctgctgcgcggccgcaacgccgtcggctacacgccctacccggaccgggtcgtgcaggtcttcgtcgccgaggcggcggccaccggcgtcgacgtcttccgcgtgttcgacgccctgaacgacctcgagcagatgcgtcccgcgctcgacgccgtccgcgaggccggcaaggtcgcggagggcacgctctgctacaccggcgacctgacgaacccgggcgagcggctctacacgctcgactactacctgcgcctcgccgaggggctcgtcgaggcgggcgcgcacgtgctggccgtcaaggacatggccgggctgctgcgcccgcgcgccgccgacacgctggtccgggcgctgcgcagccgcttcgagctgcccgtgcacctgcacacccacgacacgaccggcgggcagctcgcgacgctgctcgccgccagcgacgcgggggtcgacgccgtcgacgccgccatggcgccgatgtcgggcggcaccagccaggtcaacctgtcggccctggtcgccgcgaccgaccacaccgagcggtccacgggcctgtcgctggccgcgctgtcggcgctcgagccgtactgggaggcggtgcgcgacctctacgcgccgttcgaggcgggcctgcgggcgccgaccggcaccgtctaccgccacgagatcccgggcggccagctcaccaacctgcgccagcaggcgatcgcgctcggcctcggcgaccgctgggaggacgtccaggagctgtacgccgtcgccaacgagctgctcggcaagccgatcaaggtgacgccgacgagcaaggtcgtcggcgacctggcgatcttcctggccagcggcgacgtcgacgtcgagcggctgcgcgaggacccgggggcgtacgacctgccggccagcgtgctcggctacctcgccggcgagctgggcacgccgcccgccggcttccccgagccgttccgctccaaggcggtcgcgggccgtgcggaggagctgccggaggtcgtcctcgacccggccgacgacgcggccctcgacggcgagcagcggcgcgacgtgctgtcgcggctgctgttctccggcccgtggaaggactaccagtcggcgctcgccgagcacggcgacgtctcgatgatccccacggaggcgttcttctacggcctgcagcccggcgggacggtcaccgtctgcctcgaggccggggtcgaggtgctcgtcgagctgcagacggtcggcgagctgtccaaggacggcctgcggaccctccacgtgcgcgtgaacggccagccccggccggtgcaggtgcgcgaccgctcggtcaaggtcgccgacacggccgcgcgccgcgccgaccccggcgacccccgccacgtcggcgcggccctgcccgggctcgtcctgccgaaggtcgccgtcggcgaccgggtgaccaagggacaggcgctggccgtcgtcgaggcgatgaagatggagtcgaccgtctcgagccccgccgacgggaccgtggccgaggtcgccgtgacggccggcaccaacgtcgaggtgggcgacctgctcgtggtcctgggcgactga

SEQ ID NO: 263 - protein, 1130 aa, Unknown
  pyc_11 sequence from unknown bacterial species from environmental sample
MPVRESLVRKVLVANRSEIAVRVMRAAHEMDLLTVGVYTPEDRGALHRTKAGEAYQLGEPGHPVRGYLDVEALLEVARRSGADALHPGYGFLSESAALADACASAGITFVGPPADVLRLTGDKVTARQAAVAAGLPVLRASDPLPDGSGAIEAAEAVGFPLFVKAAAGGGGRGLRLVRTPEELADAALSASREAAAAFGDGTIFLEQAVERPRHIEVQVLGDTHGSVVHLFERDCSVQRRHQKVVELAPAPDLPEATRTGLHEAALAFARSVGYVNAGTVEFLVGADGAFTFMEMNPRIQVEHTVTEEVTGVDLVGAQLRVAAGESLADIGIVQERLAVRGCAVQCRITTEDPANGFRPDTGTIATYQSPGGPGVRLDGAVYAGAEVTPYFDSLLVKLTTRAPDLRTAANRTRRALREFRVRGVKTNVEFLYRLMEDEDFLSGAVPTSFLAEHPHLTDAPAVTDRTTRMLGALADATVNGLQRPSRPLLDPVSKLPDLPAAPPVQGSRRLLDEVGPERWAQALRDRTSLAVTDTTLRDAHQSLLATRLRTTDVLGAAPRTAELLPGLLSLEAWGGATYDVALRFLHEDPWQRLAALREAAPDVCLQMLLRGRNAVGYTPYPDRVVQVFVAEAAATGVDVFRVFDALNDLEQMRPALDAVREAGKVAEGTLCYTGDLTNPGERLYTLDYYLRLAEGLVEAGAHVLAVKDMAGLLRPRAADTLVRALRSRFELPVHLHTHDTTGGQLATLLAASDAGVDAVDAAMAPMSGGTSQVNLSALVAATDHTERSTGLSLAALSALEPYWEAVRDLYAPFEAGLRAPTGTVYRHEIPGGQLTNLRQQAIALGLGDRWEDVQELYAVANELLGKPIKVTPTSKVVGDLAIFLASGDVDVERLREDPGAYDLPASVLGYLAGELGTPPAGFPEPFRSKAVAGRAEELPEVVLDPADDAALDGEQRRDVLSRLLFSGPWKDYQSALAEHGDVSMIPTEAFFYGLQPGGTVTVCLEAGVEVLVELQTVGELSKDGLRTLHVRVNGQPRPVQVRDRSVKVADTAARRADPGDPRHVGAALPGLVLPKVAVGDRVTKGQALAVVEAMKMESTVSSPADGTVAEVAVTAGTNVEVGDLLVVLGD

SEQ ID NO: 264 - DNA, 3384 bp, Unknown
  pyc12 sequence from unknown bacterial species from environmental sample
atgatcgagaaggtgctggtcgccaatcgcggcgagatcgcgacccgcgccttccgagcggcgaatgagcttcggatccgcagcgtggcgttgtacgcgccggaggatcgcgactcggtccatcgcgtaaaggccgacgaggcgtacgagatcggtgcgccgggtcatccggtcagcacctacctggaccctgacatcgcggtcgcgctcgcgctgcgggtcggcgccgacgcgatctacccgggctacggcttcatgtccgaaaacccggagctcgctcgagcctgcgtcgctgccggattggtgttcgtcgggccgccaccggaggtgctcggtctcgccggcgacaagacgcgcgcgcgaacggcggcgcgcgaggcgggcgtcccggtgctcgacgcttcagagccggtcgagaacgccgaagctgcgctggcggcagccgagaagatcggcttcccggtgttcgtgaaggcgtcgcacggcggcggcgggcgcggcatgcgcctcgtgaccgatccggcgcgcctcgcggcgtcgctggaggaggcgcgcaacgaggcggaggcggcgttcggcgacggcacggtctacctcgagcaggcgctcgtgcgcccgcgccacatcgaggttcagctgctggccgacgcgaccggcgacgtcgtgcatctctacgagcgcgactgctcattgcagcgccggcatcagaaggtgatcgagatcacaccggcaccgaacctcgagccggagctgcgcgaccgcatctgcgccgacgccgtccgcttcgcccgccacgtggggtacgtcaacgcgggcacggtcgagttcctgctcgacgaggccaacgggcgctacgcgttcatcgagatgaaccctcgcattcaggtcgagcacacggtcaccgaggagacgaccgacatcgacctcgtgcgcgcacaactgcagatagccggcggcgagacgctcgccggactcggcgtgcgccaggacgacatccgccagcgcggcttcgcgctgcagtgccgggtgacgacggaggaccccgccaacgggttccgccccgactccggccgcatcaccgcgtaccgatcccccggaggggcgggcgtgcggctcgacgagggctcagccttcgtcggcgccgaggtctcgccgttcttcgacccgctgctggtgaagatctccgcgcgcgggcgtgatctgcacagcgcggtctcacgcgcgcggcgcgccgtcgccgagctgcgagtacgcggtgtcaagaccaaccagggcttcctgctcgcgctgctcaacgaccccgacgtcctcgctgggcgcacgcacaccacgttcgtcgacgagcgtcccgacctctcgaccgccggccccggcggcgaccgcgccagccgactgctcaaacgcctcgccgaggtcacggtcaaccacgagcctgccagctccgccctcgccggcgatccgcgcgcgaagctcccagcgcccccgacgggcgcgccgcccgccgggtcgcgccagaaactgctcgacctcggcccgtccacgttcgccgcggcgctgcgcggacagcaggcgatcgcgctcaccgacaccacgctccgtgacgcccaccagtcactgttcgccacgcgtatgcgcacgcgcgacatgctccccgtagcaccgcacctcgcgcacgaactgccgcagctgctgtcgcttgaggtgtggggcggcgcaaccttcgatgtcgcgctgcgcttcctgcacgaggacccgtgggaccggctcgtgcagctacgcgaactggtccccaacgtgtgcctgcagatgctcctgcgcggccagaacctgctcgcctactcccgctttcccaccagggtggtgcgtgcattcgtcgccgaggcggtcgaggccggcatcgacgtcttccgcatcttcgacgcgctcaacgacatcgaaggcatgcgctccgcgatcgaggcaacgctcgagacgcccgcgctagccgaaggaaccctgtgttacacgggcgacctgagcgacccgcgcgagcggctctacaccctcgactattacctgcgcctcgcccagcagctggtcgacgccggtgtacacatgctcgccatcaaggacatggccgggctgctgagggcacccgccgcacacacgctcgtgaccgcgctgcaccgcgagttcgaactgccggtgcacctgcacacacacgacaccgccggcgggcaactcgccacctacctcgccgccatcgaggccggcgtcgacgccgtcgatggcgccgccgcgccgatggcgggcatgaccagccagccctccctggcggcgatcgtcgccgccaccgcgacgaccgagcgcgactcgggcatcgcgctcgacgcgctcctggaccaagagccctactgggagtcggtgcgcacgctctacggcgcgttcgagaccggcctgaaggcgccgactggtcgcgtctaccgccacgagatccccggtggccagctctccaacctgcgccaacaagcggacgcggtcggcctcacgggccgcttcgacgagatcgaacgcgcctacgagcgagccaaccgactgctcggcaacgtggtcaaggtcacgccctcgagcaaggtcgtcggcgacctcgccctgtttgcggtctcagccggcatcgacttcgacgagctcgaacgccgacccggctccttcgacctccccgactccgtcatcgacttcctgcgcggcgggatcggcaccccacccggcggcttcccacaacccttcaccgacctggcactcgccggtcgccccgcgccgccggcacccacggagctcgaccccgagctcgccgaccggctacagcaacccggcgcacctcgtcgcggggcgctcgccgagatcctcttccccgggccggcgtccgacttcgccgccgcccgcgccacgttcggcgacgtctcgctgatccccacgcccgcgttcttccgcggcctgcacgaggacgaagaactggcgatcgacctcgcacccggcgtacgcctgctcttcgaactcgaagccatcggcgaacccgacaagcgcggcatgcggaccgtcctggtacgcgtcaacggccagctgcgccccgtcgaagtgcgcgaccactccgtcaagaccaccggtgtgcagatcgaacgcgcggaccccaaacgcccaggccacgtcccggcgccagtgaccgggatcgtgtccctgctcgtcgccgcgggcgacaccgtgtccgagggcgacccgatcgcaacgctcgaagccatgaagatggagtccacgatctccgcgccgctcgccggccgcgtgcaacgcctcgccgtcaccacgggtgcgcgcctggaacagggggacctcctgctcgtcatcgactag

SEQ ID NO: 265 - protein, 1127 aa, Unknown
  pyc_12 sequence from unknown bacterial species from environmental sample
MIEKVLVANRGEIATRAFRAANELRIRSVALYAPEDRDSVHRVKADEAYEIGAPGHPVSTYLDPDIAVALALRVGADAIYPGYGFMSENPELARACVAAGLVFVGPPPEVLGLAGDKTRARTAAREAGVPVLDASEPVENAEAALAAAEKIGFPVFVKASHGGGGRGMRLVTDPARLAASLEEARNEAEAAFGDGTVYLEQALVRPRHIEVQLLADATGDVVHLYERDCSLQRRHQKVIEITPAPNLEPELRDRICADAVRFARHVGYVNAGTVEFLLDEANGRYAFIEMNPRIQVEHTVTEETTDIDLVRAQLQIAGGETLAGLGVRQDDIRQRGFALQCRVTTEDPANGFRPDSGRITAYRSPGGAGVRLDEGSAFVGAEVSPFFDPLLVKISARGRDLHSAVSRARRAVAELRVRGVKTNQGFLLALLNDPDVLAGRTHTTFVDERPDLSTAGPGGDRASRLLKRLAEVTVNHEPASSALAGDPRAKLPAPPTGAPPAGSRQKLLDLGPSTFAAALRGQQAIALTDTTLRDAHQSLFATRMRTRDMLPVAPHLAHELPQLLSLEVWGGATFDVALRFLHEDPWDRLVQLRELVPNVCLQMLLRGQNLLAYSRFPTRVVRAFVAEAVEAGIDVFRIFDALNDIEGMRSAIEATLETPALAEGTLCYTGDLSDPRERLYTLDYYLRLAQQLVDAGVHMLAIKDMAGLLRAPAAHTLVTALHREFELPVHLHTHDTAGGQLATYLAAIEAGVDAVDGAAAPMAGMTSQPSLAAIVAATATTERDSGIALDALLDQEPYWESVRTLYGAFETGLKAPTGRVYRHEIPGGQLSNLRQQADAVGLTGRFDEIERAYERANRLLGNVVKVTPSSKVVGDLALFAVSAGIDFDELERRPGSFDLPDSVIDFLRGGIGTPPGGFPQPFTDLALAGRPAPPAPTELDPELADRLQQPGAPRRGALAEILFPGPASDFAAARATFGDVSLIPTPAFFRGLHEDEELAIDLAPGVRLLFELEAIGEPDKRGMRTVLVRVNGQLRPVEVRDHSVKTTGVQIERADPKRPGHVPAPVTGIVSLLVAAGDTVSEGDPIATLEAMKMESTISAPLAGRVQRLAVTTGARLEQGDLLLVID

SEQ ID NO: 266 - DNA, 3429 bp, Unknown
  pyc_13 sequence from unknown bacterial species from environmental sample
gtgctgaagaaggttctggttgccaaccggggagagatagccatacgcgccttccgggccgcttacgagctaggtatccgcaccgtcgcggtctacacgccagaggacagggactcgttgcaccggcagaaggccgacgaggcgtacgggatcggcgaggcggggcacccggtgagagcttacctggacgtcgagacgctggtcgataaggccctggaggtcggggccgactcgatctacccgggctacggctttctctccgagagcgcaaagctcgcgtcggcgtgcgaggaggccggccttaccttcgtgggacccccgagcgaggtcctctcccttaccggagacaagatcgaggcgcgagaggcggcggagtccgccggaatctcgatcacccaagcgtcggggctgatctctgaccccaacgaggcttcggaggcggccgaggaggttgggtatccgctcttcgtgaaggcagccggtgggggagggggcagaggtatgcgcttggtcagggatgccggcgacctgcaagaggcggtggatgcggcgacgagcgaggcggagtccgcgttcggtgacccgtcggtctttctggagcaggccctcgtgagaccccggcacatagagatccaggtgctcgccgacgcggaaggggaggttatacacctctacgagcgcgattgctcggtgcagcggcgtcaccagaaggtcctggagatggcgccggcgccgaacctggatccggacctcagggaccgattgtgcgaggatgcggtccgcttcgcccgcgaggtcggctacctcaacgccggtacggtcgagtttttggtcggggaagacggtgagtacgctttcatcgagatgaacccccgcatccaggtcgaacacaccgtcaccgaggagaccaccgacgtagacttggtcagcgcccagctgaggatcgccgggggggagacgctggaggatctgggtctctcccaggaaggtatagagcagcgcggtgttgctttgcagtgccgggtgaccaccgaagacccggcgcagaactttcagccggatacgggccggatctcggcctaccgctcgccgggcgggttgggtatccgcacggacggcggcaccgtctactccggcgccgaggtcagcccgtacttcgacccgctcctcgtcaaggtcaccgctcgtggtcccgacctgctcaccgcggcgaggagggcgagtagggcactcgccgagatacgggtgcgcggcctggcaacgaacgtggccttcctccgggccgtcctcaacgacgacgactttctggccgggcggacgaacacctcctttatagacgagaggccgcaccttacccaggcctacgcgggtagggaccgggcgacccgcctgctctcgctgctcgccgacgtcaccgtcaatcggccaaacggcccgccacccgaagcgcccgacccgcgcaccaagctgccgtcgctaccggagggtgacgcgccggccggcactaagcagaagctagacgagctcggcccggagggcttcgcccgctggatgcgcgagtccgaggccctgctcgtcactgataccaccatgcgcgacgcccaccagtccctcttcgcgacccggatgcgaaccttcgacatgctcgccgtcgcccctcacctggcacggatgcttccgcagatcttctccgccgaggtgtggggtggggcgaccttcgacgtggctctgcgctttctgcgcgaggatccctgggaacggctgggccgtctgcgggaggcgctcccgaacacgtgcctgcagatgctcctccggggccagaatgccgtcggctacacgacctacccggacgacgtgctaaaggccttcgtcgccgaaaccgccgagaccggcctcgacatcttccgcgtcttcgacgccaacaacgacatccgcaggatgcgaccggccatagaggcggtgctcgagaccgacgccgtcgcggagggtgcgatctcctacaccggcgacctctcgaacccggacgaggagctctacaccctcgactactacctgcggctcgccgaggagttggtcgaggccggctcgcacgtcctgtgcataaaggacatggccggcctcctgcgcgcccccgccgccgagaagctcataagttctctgcggagcgagttcgacctaccggtccacctgcacacccacgacaccgccggcggccaactcgccacctatctcgcggccttacgagcgggggtagacgccgtagacggcgccgccgccccgatgtccgggatgacgagccagccgtccctggcggccatagtggcgacgaccgagcacacggagcgcgaaaccggcctctcgctcgacgccctgggcgatctggagccctactgggaggcggtgagggacctctacgcgcccttcgagtctgggctgcgctcaccgacgggtaccgtttatcagcacgagataccgggcggccagctctcgaacctgcgcgtgcaggcgacggccctggggctcggggaacgcttcgaggagatagagtacgcctacgcccgctgcgacgagctattggggcacctggtcaaggttacgcccacgagcaaggtcgtcggcgacctagctctgtatctcgtctcctccaacatagatcccggtgagttcgaggaggaccccgccgactacgacctgccggagagcgtgatcggctttctgcgcggggagatcggcgagccgccgggtggctggcccgaacccttgcgctccgaggtgctctcgcgacaggatgagaacggctcgtcctcggccgggccctccgaggacgggtcctccggggatgagcaactccccgaggaggaccgggaggcgctcgcgcaggccgagcgtggctcggagcgacgggccgcgctgaaccgattgcttctgcccgacccggccgccggtaaggaggaggccgaggagagatacggcgacgtctccgtgatacccacgaagccctttttctacgggctggagaccgggcaggagctcgacctggacctcgagcccggcgtcaggttgcacgtggggctggaggcgatctcggaggccgaccagcgcggcatccgggccctcatcgtcacggtcaacggccaatcgaggagcgtagacgctcaggaccgctcgctggagccggagacgccgagcacggagaaggccgacccgaacgaggaaggacacgtcgcagccccgatgacgggcgcggtgacgctcgccgtcgaggagggcgaggaggtcgaggagggccagcagctcggcacgatggaggcgatgaagatggagtccgccataagcgcccccgtctcgggaaccatcgagcgcatcgccgtcccctccggcaccaacgtcgagtccggcgacctcctgctcgtactggagacctcttga

SEQ ID NO: 267 - protein, 1142 aa, Unknown
  pyc_13 sequence from unknown bacterial species from environmental sample
VLKKVLVANRGEIAIRAFRAAYELGIRTVAVYTPEDRDSLHRQKADEAYGIGEAGHPVRAYLDVETLVDKALEVGADSIYPGYGFLSESAKLASACEEAGLTFVGPPSEVLSLTGDKIEAREAAESAGISITQASGLISDPNEASEAAEEVGYPLFVKAAGGGGGRGMRLVRDAGDLQEAVDAATSEAESAFGDPSVFLEQALVRPRHIEIQVLADAEGEVIHLYERDCSVQRRHQKVLEMAPAPNLDPDLRDRLCEDAVRFAREVGYLNAGTVEFLVGEDGEYAFIEMNPRIQVEHTVTEETTDVDLVSAQLRIAGGETLEDLGLSQEGIEQRGVALQCRVTTEDPAQNFQPDTGRISAYRSPGGLGIRTDGGTVYSGAEVSPYFDPLLVKVTARGPDLLTAARRASRALAEIRVRGLATNVAFLRAVLNDDDFLAGRTNTSFIDERPHLTQAYAGRDRATRLLSLLADVTVNRPNGPPPEAPDPRTKLPSLPEGDAPAGTKQKLDELGPEGFARWMRESEALLVTDTTMRDAHQSLFATRMRTFDMLAVAPHLARMLPQIFSAEVWGGATFDVALRFLREDPWERLGRLREALPNTCLQMLLRGQNAVGYTTYPDDVLKAFVAETAETGLDIFRVFDANNDIRRMRPAIEAVLETDAVAEGAISYTGDLSNPDEELYTLDYYLRLAEELVEAGSHVLCIKDMAGLLRAPAAEKLISSLRSEFDLPVHLHTHDTAGGQLATYLAALRAGVDAVDGAAAPMSGMTSQPSLAAIVATTEHTERETGLSLDALGDLEPYWEAVRDLYAPFESGLRSPTGTVYQHEIPGGQLSNLRVQATALGLGERFEEIEYAYARCDELLGHLVKVTPTSKVVGDLALYLVSSNIDPGEFEEDPADYDLPESVIGFLRGEIGEPPGGWPEPLRSEVLSRQDENGSSSAGPSEDGSSGDEQLPEEDREALAQAERGSERRAALNRLLLPDPAAGKEEAEERYGDVSVIPTKPFFYGLETGQELDLDLEPGVRLHVGLEAISEADQRGIRALIVTVNGQSRSVDAQDRSLEPETPSTEKADPNEEGHVAAPMTGAVTLAVEEGEEVEEGQQLGTMEAMKMESAISAPVSGTIERIAVPSGTNVESGDLLLVLETS

SEQ ID NO: 268 - DNA, 3387 bp, Unknown
  pyc_14 sequence from unknown bacterial species from environmental sample
atgctgcgcaagctcttggtcgccaaccgcggcgagatcgccatccgggcgttccgcgcggcctacgagctcggcatcgccaccgtcgccgtctacacccaccccgaccgcgtgtcgctccaccgatccaaggcggacgaggcgtacgagatcggcgaccccgcctcggcgctgcgcggctacctcgaccccgcgctcatcgtcgacacggcggtgcgggtgggcgcggacgcgatctatcccggctacgggttcctctccgagtcggagctgttcgcgcaggcctgcgtcgatgccggggtgatcttcgtcgggccgcctcccgaggtcctgcgcctgaccggcgacaagctgcgggcgcgcgacgccgctcgcagggcggggttgcccgtgctcgaggccagcccggcggtcgccgacgccgacgcggcccgcgaggccgcctcctcgctcgggtatccggtgttcgtcaaggccgcgggcggcgggggcggtcgcggcctgcgccgggtcgagcggcccgaggaccttccgggcgccgtcgagaccgcgatgcgcgaggcccagggggcattcggggatcggaccatcttcctcgagcaggcggtcatccggccccgccacatcgaggtgcagctgctcgccgatgccgacggcgaggtcgtccatctctacgagcgcgactgctcgatccagcggcggcaccagaaggcgctggagctggcgccggccccgggcatcacccccgagctgcgccagcgcctctgcgccgacgccgtgtccttcgcccgcgcggtgggctaccgcaacgcgggtaccgccgagttcctggtcggccaggacgggcgccacgtcttcatcgagatgaacccccgcatccaggtcgagcacaccgtgaccgaggagaccaccgacgtcgacatcgtcggatcacagctgcgcatcgcagggggcgcgacgctggctgacctcgggctgtcccaggaccggatcgtgcagcggggcgcggcggtgcagtgccgcatcacgacggaggaccccagcaacggcttccgccccgacaccggccgcatcgtggcctaccgctcgccgggcggagccggcatccgcctcgacgccggcagcgcctacgtgggcgcggaggtctccccctacttcgactcgatgctggtcaagctgaccgcccgcggctccgacctgcaggtcgccgccacccgcgcccgccgcgccctcgcggagttccgcatccgcggcgtcagcacgaacacccgcttcctgtccgcggtgctggccgatcccgacttcctggcgggcaagctgtccacctcgttcctggacgagcgcccctggctggtctcgacgaccaccggcgaggaccgcgccacccggctgctgcgccgcctggccgacgtcaccgtgaaccggccacacggtgcggcgcccacgacggtcgatccggtctccaagctgccgccgctgcccggcggcgagcccccgcccggctcccgccagcggctggccgagttcggtccgcgggccttcgcgcgggcgctgcgcgagcaggcggccctcgcggtcaccgacacgaccctgcgtgacgcgcaccagtcgctgctggccacgcgcatgcggacacgcgacatgctggccgcggcgccgcatgtcgcccacggtatgggcggcctgctgagcttcgaggtctggggcggcgcgaccttcgacgcggcgctgctgttcctcggcgaggacccgtgggagcggctggcccacctgcgcaccgtgctgcccaacgtgtgcctgcagatgctgctgcgcggcgagaacctggtcggctacacgacctacccggcgccggtggtccgctccttcgtcgccgaggcgcgcgcgtgcgggatcgacatcttccgcgtcttcgacgccaacaacgacgtcgagcggatgcgcccggccatcgaggccgtcgccgaggagggcgggctggccgagggcactctgtgctacaccggcgacctgtctaccccgggcgagcggtacgacctcgaccactacctgaccgtcgccaagggctgcctcgaggccggcgcgcacatcctgtgcatcaaggacatggcggggctgctgcgggcaccggccgcgcgcacgctggtcaccgccctgcgcgacagcttcgacgcgccggtgcacatgcatactcacgacagcgccggcgggcagctcgccacctacctcgccgccatcgcggccggcgtcgacgcggtcgacggcgccgcggcgccgctgtcgggcggcaccagccagccctcgctcgcggcgatcgtggccgcgaccgatcacacggagcgtgcgaccggcctgtcgcttgacgcgctggccgacctcgagccctactgggaggccgtgcgcaccctctacgcccccttcgaatccgggctgcgcgccccgaccggcgccgtgtaccgccacgagatccccggcggccagctgtccaacctgcgccagcaggcggtggcgctggggctcggcacccggttcgaggaggtcgagcgcgtctacgcccgctgtgacgacctgctcggcgggctcatcaaggtgacccccaccagcaaggtcgtcggcgacctcgcgctctacctcgtgtcggctggcatcgatcccggggagctggaggccgatcccgccaggtacgacctgcccggctcggtgatcggcttcctgcagggcgagctgggcgagccacccttcgggtggcccgagccgtttcgctccaaggcgctggcgggcaagcccgaccacgtcgacccgccggccctcgacgccgaccagcagcgcgacctcgacgccgccgatccagagcagcgccgccgcgcgctgagcaccctgctgctgccggctgcggcccgcgagcacctcaagtcgatcgagctgtacggcgacgtctccgtgctgcccacccgcgcctacctgtacggcctggagcccggcgaggaggtggccgtagacctcgaaccgggcgtgcggctgttcctgcagctcgaagcggtcggcgaggtcgacaagcgcggcgtgcgcaccgtgctggtcaacgtcaacggccaggcccgccccatcgaggtccaggaccgctccgccgaggtcaccgccaaggtcaccgagaaggccgatcccgccagaccgggtcacatccccgcgcccttgaccggcgtcgtcgccatgcgcgtcgccgaaggcgaccaggtcgaggccggcgcccagctcgccacgatcgaggccatgaagatggaaagctctatcagcgcccccttcgccgcccgcatcgaccgcctcgtcgtcaccgacggcacggccgtcgaacccggcgatctcctcctcgtcctctcccaggcgtga

SEQ ID NO: 269 - protein, 1128 aa, Unknown
  pyc_14 sequence from unknown bacterial species from environmental sample
MLRKLLVANRGEIAIRAFRAAYELGIATVAVYTHPDRVSLHRSKADEAYEIGDPASALRGYLDPALIVDTAVRVGADAIYPGYGFLSESELFAQACVDAGVIFVGPPPEVLRLTGDKLRARDAARRAGLPVLEASPAVADADAAREAASSLGYPVFVKAAGGGGGRGLRRVERPEDLPGAVETAMREAQGAFGDRTIFLEQAVIRPRHIEVQLLADADGEVVHLYERDCSIQRRHQKALELAPAPGITPELRQRLCADAVSFARAVGYRNAGTAEFLVGQDGRHVFIEMNPRIQVEHTVTEETTDVDIVGSQLRIAGGATLADLGLSQDRIVQRGAAVQCRITTEDPSNGFRPDTGRIVAYRSPGGAGIRLDAGSAYVGAEVSPYFDSMLVKLTARGSDLQVAATRARRALAEFRIRGVSTNTRFLSAVLADPDFLAGKLSTSFLDERPWLVSTTTGEDRATRLLRRLADVTVNRPHGAAPTTVDPVSKLPPLPGGEPPPGSRQRLAEFGPRAFARALREQAALAVTDTTLRDAHQSLLATRMRTRDMLAAAPHVAHGMGGLLSFEVWGGATFDAALLFLGEDPWERLAHLRTVLPNVCLQMLLRGENLVGYTTYPAPVVRSFVAEARACGIDIFRVFDANNDVERMRPAIEAVAEEGGLAEGTLCYTGDLSTPGERYDLDHYLTVAKGCLEAGAHILCIKDMAGLLRAPAARTLVTALRDSFDAPVHMHTHDSAGGQLATYLAAIAAGVDAVDGAAAPLSGGTSQPSLAAIVAATDHTERATGLSLDALADLEPYWEAVRTLYAPFESGLRAPTGAVYRHEIPGGQLSNLRQQAVALGLGTRFEEVERVYARCDDLLGGLIKVTPTSKVVGDLALYLVSAGIDPGELEADPARYDLPGSVIGFLQGELGEPPFGWPEPFRSKALAGKPDHVDPPALDADQQRDLDAADPEQRRRALSTLLLPAAAREHLKSIELYGDVSVLPTRAYLYGLEPGEEVAVDLEPGVRLFLQLEAVGEVDKRGVRTVLVNVNGQARPIEVQDRSAEVTAKVTEKADPARPGHIPAPLTGVVAMRVAEGDQVEAGAQLATIEAMKMESSISAPFAARIDRLVVTDGTAVEPGDLLLVLSQA

SEQ ID NO: 270 - DNA, 3438 bp, Unknown
  pyc_15 sequence from unknown bacterial species from environmental sample
atggtccgcaagctgctcgttgccaaccgcggcgagatcgccatccgcgcgtttcgtgctgcgaccgagctcggcatcgccacggtggcggtgtacacccaggaagaccgtgactccctccaccgcctcaaggccgacgaggcatatcagatcggcgagcccggccatcccgtccgcgcgtacctcgacggggctgcgctcatcgcgcttgccgggcgcatcggcgcggatgcggtttacccgggctatgggttcctgtccgagaacgcggagttcgccgccgactgtgcggctgccggcctgacgttcgtgggtccgccgcccagcgtgttgcggttgaccggcgacaagaccgaggcgcgacggctggcgcgcgacgctgggctgcgcgtgctcgaggcgagcgacatccttgcggatcccgcggacgctgcggcggccgccgagcagctgggatatcccgtgttcgtgaaggccgctgccggtggtggcggtcgcggtctgcgcagggttgagtcgcccgccgacctggcgggcgcggttgagacggccattcgcgaggcgcatggcgccttcggcgatgagcgggtgttcctcgagcacgccgtaacacggccgcggcacatcgaagtgcaggtgcttgccgatgaccgcggcgaggtcatccacctgtgggagcgtgattgctcggtccagcgacgccatcagaaggtgatggagatcgcgccggcgccaaagctggatccggcgctgcgtgaggcgatctgtgctgacggggtccggttcgctcgcgcggctggctaccgcaacgccggcacggtggagttcctgctcgatcgcaacggcacgcacgtgttcatcgagatgaacccgcgcatccaggtcgagcacaccgtgaccgaggaggtcaccgacgtcgatctggtgcaagcgcagctgcggatcgcctccggcgagacgctggccgacctcggactcacccaggacacggtggccacgcgtggatccgcgatccagtgccggatcaccacggaggactcagccaacgggtttcgccccgataccggtcgcatcacggcctaccggtcggcggccggggcaggcatccgcctcgacgccggctcggccttcgttggctcacaggtcagtccgttcttcgactcgttgctggtcaagctgacggccagaggtcgcgacttccccgccgccgcgcaacgcgcgcgccgggcgctggcggagttccgcgtgcgcggcgtggcgaccaacatggcgttcctgggcgccgtgctcgccgatcccgacttcctggccggcaacctgtcgaccacgttcatcgacgagcgaccgcacctggtcagcaccagcgcgggtcgcgaccgcgggacgcgcctgctggagtacctggccaacgtcacggtcaaccggccgcatggcacggtgcgcgatgtggttgacgcgcgcgacaagctgccgccgctccccgccgagccgacggtgagggcgaccgccagcgagccggcgggcggggacctcatggtcccgccgggcgctcgccagcaactgcaagcgctgggcccggagcgcttcgcgcgctggctgcgggagcgcgacgccgtggggctgaccgacaccacgttccgcgacgcgcaccagtcgctgctcgccacgcggatgcggacattcgacatgctcgcggtggcgccgcacatcgccgccggcctgccggaactgttcagcctggagatgtggggcggcgccacctatgacgtggcgctgcggttcctgcacgaggatccctggcagcggctggcggccatgcgggaggccgtgcccaacatctgcctgcagatgctgctgcgcggccagaacgcggtcggctactcggcctatccgagcgatgtggtgcgcgccttcgtggccgaagccagcctcaccggcatcgatatcttccggatcttcgatgcccttaacaacgtgacggcaatgcgcgccgcgatcagcgcgacgctcgaggcgggtgccgtggccgaaggcgccatctgctacaccggcgacctccacgatcccgccgaacgcgtgtacacgctcgactactacctgggtgtcgccgaggagctcgtcgaagcgggcgtgcacatcctgtgcatcaaagacatggcgggcctgctgcgcccacctgctgcgcgcacgctgatagccgcgctgcgcgagcgcttcgaccagccggtgcacctgcatacgcacgacaccgccggcggccagctcgggaccgtggtggccgccatcgacgcgggcgtggatgccgtcgacggtgcggccgcgccgctgtcgggcatgaccagccagcccaacctcgccgcgatcgtggcagccaccgaccacaccccacgcgcaacgggagtgtcgctggacacgctgaccgcgctggagccctactgggaggcggtgcgcaaccagtacgcgccgctggaggcgggtctgcgctcgccgaccggagccgtctacgaccacgagatccccggtggccagctgtcgaacctgcgtcagcaggcgatcgcgttggggctcggtgaccggttcgagcacctgacccggctctaccggcagtgcaacgatctgctcgggaacatgatcaaggtcacgccgaccagcaaggtcgtgggcgacctggcgctgtacctcgacagcgccggcatcacgcccgagcagctggtggccgacccagcgcgctacgatctgcccgacagcgtcatcggctacctgcacggtgagcttggaaccccgcccggcggctggcccgagccgttgcgcggcaaggtggtggccgcccgccccaaccgtccgccgcccccgacgttgaccgaccaccagcgcaccgccctgcgcgagcgctcggggcggtaccgtcaggagctgttgaacgagctgctgttccccggtccggcggcggcgcgagccgagatgcggcagcggttcggcgacgtctccatcctgccgacgtgggcgttcctctacggcctcacgccacgccgggagctgcatgttgatctggcccccggcgtgcggttgttcatccacctggaggccgtcagcgaacccgacgaacagggcatccgtaccgtgctgtgcacgctgaacgggcaggtgcgaccggtcgatacgcgcgaccgttctatcgaagccgccacggagcctgccgagcgcgctgatctcaacgatcccagccacgtggcagcgccgctgaccggggtggtgaccatcgtcgtgtcgcccggcgagcacgtggccgccggcgccaagctcggttccatcgaagccatgaagatggagtccaacatcagcgcaccccacgccggcacggtctcccgcgtgctcaccggcagcggcacggcagtcgagccgggtgacctcctcctggtcctcgaccccgacgactga

SEQ ID NO: 271 - protein, 1145 aa, Unknown
  pyc_15 sequence from unknown bacterial species from environmental sample
MVRKLLVANRGEIAIRAFRAATELGIATVAVYTQEDRDSLHRLKADEAYQIGEPGHPVRAYLDGAALIALAGRIGADAVYPGYGFLSENAEFAADCAAAGLTFVGPPPSVLRLTGDKTEARRLARDAGLRVLEASDILADPADAAAAAEQLGYPVFVKAAAGGGGRGLRRVESPADLAGAVETAIREAHGAFGDERVFLEHAVTRPRHIEVQVLADDRGEVIHLWERDCSVQRRHQKVMEIAPAPKLDPALREAICADGVRFARAAGYRNAGTVEFLLDRNGTHVFIEMNPRIQVEHTVTEEVTDVDLVQAQLRIASGETLADLGLTQDTVATRGSAIQCRITTEDSANGFRPDTGRITAYRSAAGAGIRLDAGSAFVGSQVSPFFDSLLVKLTARGRDFPAAAQRARRALAEFRVRGVATNMAFLGAVLADPDFLAGNLSTTFIDERPHLVSTSAGRDRGTRLLEYLANVTVNRPHGTVRDVVDARDKLPPLPAEPTVRATASEPAGGDLMVPPGARQQLQALGPERFARWLRERDAVGLTDTTFRDAHQSLLATRMRTFDMLAVAPHIAAGLPELFSLEMWGGATYDVALRFLHEDPWQRLAAMREAVPNICLQMLLRGQNAVGYSAYPSDVVRAFVAEASLTGIDIFRIFDALNNVTAMRAAISATLEAGAVAEGAICYTGDLHDPAERVYTLDYYLGVAEELVEAGVHILCIKDMAGLLRPPAARTLIAALRERFDQPVHLHTHDTAGGQLGTVVAAIDAGVDAVDGAAAPLSGMTSQPNLAAIVAATDHTPRATGVSLDTLTALEPYWEAVRNQYAPLEAGLRSPTGAVYDHEIPGGQLSNLRQQAIALGLGDRFEHLTRLYRQCNDLLGNMIKVTPTSKVVGDLALYLDSAGITPEQLVADPARYDLPDSVIGYLHGELGTPPGGWPEPLRGKVVAARPNRPPPPTLTDHQRTALRERSGRYRQELLNELLFPGPAAARAEMRQRFGDVSILPTWAFLYGLTPRRELHVDLAPGVRLFIHLEAVSEPDEQGIRTVLCTLNGQVRPVDTRDRSIEAATEPAERADLNDPSHVAAPLTGVVTIVVSPGEHVAAGAKLGSIEAMKMESNISAPHAGTVSRVLTGSGTAVEPGDLLLVLDPDD

SEQ ID NO: 272 - DNA, 3384 bp, Unknown; identical to SEQ ID NO: 264
  pyc_16 sequence from unknown bacterial species from environmental sample

SEQ ID NO: 273 - protein, 1127 aa, Unknown; identical to SEQ ID NO: 265
  pyc_16 sequence from unknown bacterial species from environmental sample

SEQ ID NO: 274 - DNA, 3372 bp, Unknown
  pyc_17 sequence from unknown bacterial species from environmental sample
gtgcgcaaggtcctcgtcgccaaccgcagtgagatcgcggtccgcgtcatgcgcgcggcccacgagatggacctgctgaccgtcggcgtctacacgcccgaggaccgcggggcgctgcaccgcaccaaggcgggggaggcctaccagctcggcgagcccggccacccggtccgcggctacctcgacgtcgaggcactgctcgaggtcgcccgccgctcgggcgccgacgcgctgcaccccggctacggcttcctgtccgagagcgcggcgctcgccgacgcctgcgccgccgcgggcgtcaccttcgtcgggccgcccgccgacgtgctgcgcctgaccggcgacaaggtcaccgctcgccaggcggcggtcgccgccggcctgccggtgctgcgcgcctcggacccgctgccggacggcgagggcgcgatcgaggcggcggaggcggtcggcttcccgctgttcgtcaaggcggcagccggtggcggtggccgcggcctgcgcctggtgcagacgccggaggagctcgcggacgctgcccggtcggcgtcgagggaggcggccgcggcattcggtgacgggaccatcttcctcgagcaggccgtcgagcggccgcgccacatcgaggtgcaggtgctcggcgacacgcacgggtcggtggtgcacctgttcgagcgcgactgctcggtgcagcgccgccaccagaaggtggtggagctcgcgccggcacccgacctgccggaggccacccgcacgggtctgcacgaggcggcgctggcgttcgcccgctcggtgggctacgtcaacgccggcacggtcgagttcctcgtcggggccgacggcgcgttcacgttcatcgagatgaacccgcgcatccaggtcgagcacacggtcaccgaggaggtcaccggcgtcgacctcgtcggcgcccagctgcgggtcgcgcgcggcgagacgctcgagcagatcggcatcgtgcaggaccgtctgtcggtgcgcggctgcgcggtgcagtgccgcatcaccaccgaggaccccgccaacggcttccgccccgacaccggcaccatcgcgacctaccagtcgccgggcggcccgggcgtccgcctcgacggcgccgtctacgcaggcgccgaggtcacgccgtacttcgactcgctgctcgtcaagctcacgacgcgcggccccgacctgcgcaccgccgccaaccgcacccgccgggcgctgcgggagttccgcgtccgcggcgtcaagaccaacgtcgagttcctctaccggctcatggaggacgaggacttcctgtccggcgcggtgccgacgtcgttcctcgccgagcacccccacctcaccgacgccccggcggtcaccgaccgcacgacgcgcatgctcggcgcgctggccgacgcgaccgtgaacggcctgcagcgaccgtcccgggcgctgctcgaccccgtcagcaagctgccggagctgccggccgccccgccggtccagggctcccggcgcctgctcgacgaggtcgggcccgagcgctgggcgcaggcgctgcgtgagcgcacctccctcgcggtgaccgacacgaccctgcgcgacgcccaccagtcgctgctcgccacccggctgcgcaccaccgacgtcctgggcgccgcgcccacgaccgcgaagctcctgccgggcctgctgtccttggaggcgtggggcggtgcgacgtacgacgtggcgctgcggttcctgcacgaggacccctggcagcgcctcgcccagctgcgcgaggccgcccccgacgtctgcctgcagatgctgctgcgcgggcgcaacgccgtcggctacacgccctaccccgaccgcgtcgtgcaggtcttcgtcgccgaggcggccgcgacgggcgtcgacgtgttccgcgtcttcgacgccctgaacgacctcgagcagatgcgcccggcgctcgacgccgtccgcgaggcgggcaaggtcgccgaggggacgctctgctacacgggcgacctgagcgaccccggggagcggctctacacgctcgactactacctgcgcctggccgagcagctcgtcggagccggcgcccacgtgctcgccgtcaaggacatggccgggctgctgcgcccgcgcgccgcggccacgctcgtgcaggccctgcgcagccgcttcgacctgcccgtgcacctgcacacccacgacacgaccggcgggcagctcgccaccctgctcgccgcgagcgacgccggcgtcgacgcggtcgacggcgccatggcgccgatgtcgggcggcaccagccaggtcaacctgtcggcgctggtggccgcgaccgaccacaccgagcgctcgaccgggctgtcgctggcggccctgtcggcgctcgagccctactgggaggcggtgcgcgacctctacgcgccgttcgaggcgggactgcgggcgccgaccggcaccgtctaccgccacgagatcccgggcggccagctcaccaacctgcgccagcaggcgatcgcgatcggactcggcgaccgctgggaggacgtccaggagctgtacgccgtcgccaacgagctgctcggcaagccgatcaaggtgaccccgacgagcaaggtcgtcggtgacctcgcgatcttcctggccagcggcgacgtcgacgtcgagcgcctgcgcgccgacccgggggcctacgacctgccggccagcgtcctcggctacctcgccggcgagctcggcacgccaccggccggcttccccgagccgttccgcacccaggcggtcgccggccgggcagaggagctgccggaggtcgcactcgagccggccgacgacgaggccctcgacggacccgaccgtcgcgcggtcctgtcgcggctgctgttccccggcccgtggaaggactacgagacggcgctcgcggcgcacggcgacgtctcgatgatcccgaccgaggccttcttctacggcctcgagcccggcggcaccgtgaccgtctgcctcgaggccggcgtggaggtgctcgtcgagctgcagaccgtcggggagctgtcggcggacgggatgcgcacgctccacgtccgggtcaacggccagccccggccggtgcaggtgcgcgaccgctcggtgggggtggccgacacggccgcccggcgcgccgacccgggcaacccgcgccacgtcggtgcggcgctgcccggcctcgtgctgccgaaggtggcggtcggcgacacggtcaccaagggccaggcgctcgccgtcgtcgaggcgatgaagatggagtcgaccgtctcgagccccgcggacgggaccgtcgccgaggtggccgtcaccgccggcaccaacgtcgaggtcggtgacctgctggtggtgctgggcgactga

SEQ ID NO: 275 - protein, 1123 aa, Unknown
  pyc_17 sequence from unknown bacterial species from environmental sample
VRKVLVANRSEIAVRVMRAAHEMDLLTVGVYTPEDRGALHRTKAGEAYQLGEPGHPVRGYLDVEALLEVARRSGADALHPGYGFLSESAALADACAAAGVTFVGPPADVLRLTGDKVTARQAAVAAGLPVLRASDPLPDGEGAIEAAEAVGFPLFVKAAAGGGGRGLRLVQTPEELADAARSASREAAAAFGDGTIFLEQAVERPRHIEVQVLGDTHGSVVHLFERDCSVQRRHQKVVELAPAPDLPEATRTGLHEAALAFARSVGYVNAGTVEFLVGADGAFTFIEMNPRIQVEHTVTEEVTGVDLVGAQLRVARGETLEQIGIVQDRLSVRGCAVQCRITTEDPANGFRPDTGTIATYQSPGGPGVRLDGAVYAGAEVTPYFDSLLVKLTTRGPDLRTAANRTRRALREFRVRGVKTNVEFLYRLMEDEDFLSGAVPTSFLAEHPHLTDAPAVTDRTTRMLGALADATVNGLQRPSRALLDPVSKLPELPAAPPVQGSRRLLDEVGPERWAQALRERTSLAVTDTTLRDAHQSLLATRLRTTDVLGAAPTTAKLLPGLLSLEAWGGATYDVALRFLHEDPWQRLAQLREAAPDVCLQMLLRGRNAVGYTPYPDRVVQVFVAEAAATGVDVFRVFDALNDLEQMRPALDAVREAGKVAEGTLCYTGDLSDPGERLYTLDYYLRLAEQLVGAGAHVLAVKDMAGLLRPRAAATLVQALRSRFDLPVHLHTHDTTGGQLATLLAASDAGVDAVDGAMAPMSGGTSQVNLSALVAATDHTERSTGLSLAALSALEPYWEAVRDLYAPFEAGLRAPTGTVYRHEIPGGQLTNLRQQAIAIGLGDRWEDVQELYAVANELLGKPIKVTPTSKVVGDLAIFLASGDVDVERLRADPGAYDLPASVLGYLAGELGTPPAGFPEPFRTQAVAGRAEELPEVALEPADDEALDGPDRRAVLSRLLFPGPWKDYETALAAHGDVSMIPTEAFFYGLEPGGTVTVCLEAGVEVLVELQTVGELSADGMRTLHVRVNGQPRPVQVRDRSVGVADTAARRADPGNPRHVGAALPGLVLPKVAVGDTVTKGQALAVVEAMKMESTVSSPADGTVAEVAVTAGTNVEVGDLLVVLGD

SEQ ID NO: 276 - DNA, 3399 bp, Unknown
  pyc_18 sequence from unknown bacterial species from environmental sample
atgcgaaagctcctggtcgcaaaccgcggcgagatcgccacccgtgcgttccgcgccgcctacgaactgggcctccgcagcgtcgcgatctacacgccggaggatcgcgagtccgcccaccgcgtgaaggccgacgaggcctacgagatcggagagccgggacaccccgtccgcggctacctcgaccccgagctcatcgccgcgaccgcgaagtcggtgggcgccgacgccgtctatcccggctacgggttcctctccgagaacccggatctcgcgaccgcgtgcaccgagcgcgacatcacgttcgtcggcccgcccgccgaggtcctggagcgggtgggcgacaaggtccgcgcccgcacggcggcgatcgaagccggcctgcccgtgctgagcgcgaccgacctgctcgacgaggacgccgacgtggcggcgctcgccgaggagctcggcatgccggtgttcgtgaaggccgcgcacggcggcggcgggcgcggcatgcggctcgtcaccgacctggccgatctccccgaggccgtcgccgccgcgcgccgcgaggccgagagcgcgttcggcaaccccgccgtctacctcgagcaggcgatggtgcgcccgcggcacatcgaggtgcaggtgctcgcggacggccacggcgggctcgttcacctgtacgagcgcgactgctcggtgcaacgccgccatcagaaggtcgtcgagcttgcgcccgcgccgaacctcgaccccgagctgcgcgaccggatctgcgcggacgccgtgcgcttcgccggccacgtgggctacgtcaacgcgggcaccgtcgagttcctcgtcgacacggagcgcgaccggcacgtcttcatcgagatgaacccgcgcatccaggtcgagcacacggtgacggaggagacgaccgacgtcgacctggtccgcacacagctgctcgtcgccgagggcgcgcggctgcacgagctcggcctccgccaggaggacatccgccagcgcggcttcgcgctgcagtgccgcatcacgaccgaggacccgagcgccggcttccggcccgacaccggcacgatcgccgcgtaccgcgcgccaggcggcgccggggtgcgcctcgacgaggggtccgcgtacgtcggcgcggagatctcgccgtatttcgacccgctgctgctgaagctcacgacgcgcgggccggacatgcagaccgccatcgcacgcgcgcgccgggccgtcgaggaggtccgcatccgcggcgtcacgacgaaccaggcgttcctcggcaagctgctcgacgacccggacttccgctccgggcggctgcacacgacgttcatcgacgagcgcccgcagctcaccgccgtcgccccgggcggcgaccgcgcgacgcgcatcctgcgcctgctcgccgagcggacggtgaaccggccctacggccacgcgcccggcggccccgatccccgctccaagctgccccgcgtgcccaagggcgaggcgccggccggctcgcgccagcggctccaggagctggggcccgagggcttcgctcgctggctgcgttcgcgcgacgcgctgcagctcaccgacaccacgctgcgcgacgcgcaccagtccctgttcgcgacgcgcatgcgcacgcacgacatggaggcggtcgcgccgcacatggcacggctgctcggcgggctgttctcgctggaggcgtggggcggcgcgacgttcgacgtcgcgctgcgcttcctcaacgaggacccctgggagcgcatcggccggctgcgcgacctcatcccgaacgtctgcctgcagatgctgctgcggggccgcaacctgctcggctacgagccctatccggacgaggcggtcagggcgttcgtcttcgaggccgtcgacgcgggggtcgacatcttccgcatcttcgacgcgctgaacaacgtcgagccgatgcgtgcggcgatcagcgcgacggtcgaggcgggggcggtcgcggagggtgccatctgctacaccggcgacctcttggaccccggcgagcggctctacacgctcgaccactacctgcacgtcgccgagcagctcgcggaggcgggcgtgcacatcctcgccatcaaggacatggcggggctgctccgcgcgccggccgcggcccagctcgtcacccgcctgcggcgcgagttcgacctccccgtgcacctgcacacgcacgacaccgccggcgggcagctcgcgacgtacctggcggcgatcgaggcgggcgtcgacgccgtcgacggcgctgccgcgtcgatggccggcatgacgagccagccctcgctggccagcatcgtggccgccaccgaccacacggcgcgcgcgacgggcatcgccctggagtcgctgctggagctcgagccgtactgggaggcggtgcgcacgacgtacgcgccgttcgagagcggcctgcgcgcgccgaccggccgcgtgtaccgccatcagatccccggcggccagctgtcgaacctgcaccagcaggccggggcgctgggcctgggcgaccggttcgaggaggtcgagctcgcgtacgagcgcgccaacgcgctgctcggcgacatcatcaaggtcacgccgacgagcaaggtcgtcggcgacctcgcgctgttcgtcgtctcggccggcatcgactgggacgagctggccgcccagccggagcgcttcgacctcccggcgtccgtcatccagctgctgcggggcgacctcggcgagccggccggtggcttcccgcagcccttcaccgagcgcgcgctgcgcggcgctgcgcgacacagccaggacggctccgccctcgacccggagatgcgcacgcgcctggccgaggccgggaaggaccgccgcacggcgctcgccgagctgcagttccccggtcccacccaggagcgcagggacgcgtacgagcgctacggggacgtgacccatgtgcccacccggccgtttctctacggcctgcccgatgacggcgaggtctcgatcgacctcgggcccggtgtgcggctcatctacgcgctggaggcgatcggcgagcccgacgaccgcggcatgcgcaccgtcatggtgcgcgtgaacggccagctgcggccgatcgacgtgcgcgacgagtcggtcgaggcgccgacgtcgaaggtcgagcgcgccgacccggccaacgacagccacgtggcggcgccgctcaccggcgtcgtgacgctgcgcgtgaaggagcgcgaggaggtcgccgaggggcagccgatcgcgatcctcgaggcgatgaagatggagtcgacggtgacgtcgccggcggccgggacggtccagcgcgtgccggtgccgagcgggacgcgtctcgaacagggcgatctcattgcggtgatcgagaggtccgagtcggggtaa

SEQ ID NO: 277 - protein, 1132 aa, Unknown
  pyc_18 sequence from unknown bacterial species from environmental sample
MRKLLVANRGEIATRAFRAAYELGLRSVAIYTPEDRESAHRVKADEAYEIGEPGHPVRGYLDPELIAATAKSVGADAVYPGYGFLSENPDLATACTERDITFVGPPAEVLERVGDKVRARTAAIEAGLPVLSATDLLDEDADVAALAEELGMPVFVKAAHGGGGRGMRLVTDLADLPEAVAAARREAESAFGNPAVYLEQAMVRPRHIEVQVLADGHGGLVHLYERDCSVQRRHQKVVELAPAPNLDPELRDRICADAVRFAGHVGYVNAGTVEFLVDTERDRHVFIEMNPRIQVEHTVTEETTDVDLVRTQLLVAEGARLHELGLRQEDIRQRGFALQCRITTEDPSAGFRPDTGTIAAYRAPGGAGVRLDEGSAYVGAEISPYFDPLLLKLTTRGPDMQTAIARARRAVEEVRIRGVTTNQAFLGKLLDDPDFRSGRLHTTFIDERPQLTAVAPGGDRATRILRLLAERTVNRPYGHAPGGPDPRSKLPRVPKGEAPAGSRQRLQELGPEGFARWLRSRDALQLTDTTLRDAHQSLFATRMRTHDMEAVAPHMARLLGGLFSLEAWGGATFDVALRFLNEDPWERIGRLRDLIPNVCLQMLLRGRNLLGYEPYPDEAVRAFVFEAVDAGVDIFRIFDALNNVEPMRAAISATVEAGAVAEGAICYTGDLLDPGERLYTLDHYLHVAEQLAEAGVHILAIKDMAGLLRAPAAAQLVTRLRREFDLPVHLHTHDTAGGQLATYLAAIEAGVDAVDGAAASMAGMTSQPSLASIVAATDHTARATGIALESLLELEPYWEAVRTTYAPFESGLRAPTGRVYRHQIPGGQLSNLHQQAGALGLGDRFEEVELAYERANALLGDIIKVTPTSKVVGDLALFVVSAGIDWDELAAQPERFDLPASVIQLLRGDLGEPAGGFPQPFTERALRGAARHSQDGSALDPEMRTRLAEAGKDRRTALAELQFPGPTQERRDAYERYGDVTHVPTRPFLYGLPDDGEVSIDLGPGVRLIYALEAIGEPDDRGMRTVMVRVNGQLRPIDVRDESVEAPTSKVERADPANDSHVAAPLTGVVTLRVKEREEVAEGQPIAILEAMKMESTVTSPAAGTVQRVPVPSGTRLEQGDLIAVIERSESG

SEQ ID NO: 278 - DNA, 3390 bp, Unknown
  pyc_19 sequence from unknown bacterial species from environmental sample
atgcgcaagctcctggtcgcaaatcgcggcgagatcgccaccagggcgttccgcgccgcttacgaactgggcctccgcagcgtcgcgatctacacaccggaggatcgcgagtccgcccaccgagtgaaggccgacgaggcctacgagatcggggagccgggacatcccgtccgcggctacctggatcccgagctcatcgccgagacggccaagtcggtgggcgccgacgccatctatccgggctacgggttcctctcggagaacccggacctggcgaccgcgtgcgcggagcgcgacatcacgttcgtcggcccgcccgccgaggtgctggagcgggtgggcgacaaggtccgcgcgcgcaccgcggccatcgaggccgggctgcccgtcctgagcgcgacggacctgctcgacgaggacgccgacgtcgaggcgctcgccgaggagctcggcatgcccgtgttcgtgaaggccgcgcacggcggcggcgggcgcggcatgcggctcgtcaccgacgtcgccgacctccccgaggcggtcgcagcggcgcgccgcgaggccgagagcgcgttcgggaatcccgccgtctacctcgagcaggcgatggtgcgcccgcggcacatcgaggtgcaggtgctcgcggacggccacggcgggctcgttcacctgtacgagcgcgactgctcggtgcagcgccgccaccagaaggtcgtcgagctggcacctgcgccgaacctcgaccccgagctccgcgatcggatctgcgcggacgccgtgcggttcgccggccacgtgggctacgtcaacgcgggcaccgtcgagttcctcgtcgacacggagcgcgaccggcacgtcttcatcgagatgaacccgcgcatccaggtcgagcacacggtgacggaggagacgaccgacgtcgacctcgtccgcacgcagctgctcgtcgccgaaggtgcgcgcctgcacgagctcggcctccgccaggaggacatccgccagcgcggcttcgcgctgcagtgccgcatcacgaccgaggatcccagcgccggctttcggcccgacaccggcacgatcgccgcgtaccgggcgccgggcggcgccggagtgcgcctcgacgaggggtccgcgtacgtcggcgcggagatctcgccctacttcgacccgctgctgctgaagctcacgacgcgcgggccggacatgcagaccgccatcgcacgcgcgcggcgcgccgtcgaggaggttcgcatccgtggcgtcacgaccaaccaggcgttcctcggcaagctgctcgacgacccggacttccgctccgggcggctgcacacgacgttcatcgacgagcgcccgcagctgacggcagtcgcccccggcggcgaccgcgcgacgcggatcctgcgcctgctcgccgagcggacggtgaaccggccctacggccacgcgccggacggccccgatccccgctccaagctgccgcgcgcaccgaagggtgagccgcccgccggctcgcgccagcgcctgcaggagctggggccggagggcttcgcgcgctggctgcgctcgcgcgacgcgctgcagctcaccgacaccacgttgcgcgacgcgcaccagtcgctgttcgcgacgcgcatgcgcacacacgacatggaggcggtcgcgccgcacctggcacggctgctcggcgggctgttctcgctggaggcgtggggcggcgcgacgttcgacgtcgcgttgcgcttcctcaacgaggacccgtgggagcgcatcggccggctgcgcgacctcattccgaacgtctgcctgcagatgctgctgcggggccgcaacctgctcggctacgagccctatccggacgaggcggtcagggcgttcgtcttcgaggccgtcgacgcaggggtcgacatcttccgcatcttcgacgcgctgaacaacgtcgagccgatgcgcgcggcgatcagcgcgacggtcgaggcgggggcggtcgcggagggcgccatctgctacaccggcgacctcctggaccccggcgagcggctctacacgctcgaccactaccttcacgtcgccgagcagctcgtcgaggcgggcgtgcacatcctcgccatcaaggacatggcggggctgctccgagcgccggccgcggcccagctcgtcacccgcctgcggcgcgagttcgacctccccgtgcacctgcatacgcacgacaccgccggcggccagctcgcgacatacctggcggcgatcgaggcgggcgtggacgccgtcgacggcgccgccgcgtcgatggccggcatgaccagccagccctcgctggccagtatcgtcgccgccaccgaccacacggcccgcgcgaccggcatcgccctggagtcgctgctggagctcgagccgtactgggaggcggtgcgcaccacgtacgcgccgttcgagagcggcctgcgcgcgccgaccggccgcgtgtaccgccatcagatccccggcggccagctgtcgaacctgcaccagcaggccggggcgttgggcctcggcaaccggttcgaggaggtcgagctcgcgtacgagcgcgccaacgcgctgctcggcgacatcatcaaggtcacgccgacgagcaaggtcgtcggcgatctcgcgctgttcgtcgtctcggccggcatcgactgggacgagctggccgcccagccggagcgcttcgacctcccggcgtcggtcatccaattgctgcgaggtgacctcggcgagccggccggcggctttccccagcccttcaccgagcgcgcgctgcgcggcgccgcgcgtgacagccgggacggctccgcgctcgagccggagatgcgcacgcgcttggccgaggccggaaacgaccgccgtaccgcgctcgccgagctgcagttccccggccctacccaggagcgcagggacgcgtacgagcgctacggggacgtcacgcccgtgccgacccggccgttcctctacggcctgcccgatgacggcgaggtctcgatcgacctcgggcctggcgtgcggctcatctacgcgctggaggcgatcggggagcccgacgaccgcggcatgcgcagcgtcctcgtgcgcgtgaacgggcagctgcggccgatcgacgtgcgcgacgagtccgtcgaggcgccgacgtcgaaggtcgagcgcgccgacccggccaacgacagccacgtggcggccccgctcaccggtgtcgtgaccgtgcgcgtgaaggagggcgacgaggtctccgagggtcagccgctcgcgatgctcgaggcgatgaagatggagtcgacggtgacctcgcccgccgccggaacggtgcagcgggtgccggtgccgagcggcacgcgcctggagcagggcgatctcattgcggtgatcgagcagtcctag

SEQ ID NO: 279 - protein, 1129 aa, Unknown
  pyc_19 sequence from unknown bacterial species from environmental sample
MRKLLVANRGEIATRAFRAAYELGLRSVAIYTPEDRESAHRVKADEAYEIGEPGHPVRGYLDPELIAETAKSVGADAIYPGYGFLSENPDLATACAERDITFVGPPAEVLERVGDKVRARTAAIEAGLPVLSATDLLDEDADVEALAEELGMPVFVKAAHGGGGRGMRLVTDVADLPEAVAAARREAESAFGNPAVYLEQAMVRPRHIEVQVLADGHGGLVHLYERDCSVQRRHQKVVELAPAPNLDPELRDRICADAVRFAGHVGYVNAGTVEFLVDTERDRHVFIEMNPRIQVEHTVTEETTDVDLVRTQLLVAEGARLHELGLRQEDIRQRGFALQCRITTEDPSAGFRPDTGTIAAYRAPGGAGVRLDEGSAYVGAEISPYFDPLLLKLTTRGPDMQTAIARARRAVEEVRIRGVTTNQAFLGKLLDDPDFRSGRLHTTFIDERPQLTAVAPGGDRATRILRLLAERTVNRPYGHAPDGPDPRSKLPRAPKGEPPAGSRQRLQELGPEGFARWLRSRDALQLTDTTLRDAHQSLFATRMRTHDMEAVAPHLARLLGGLFSLEAWGGATFDVALRFLNEDPWERIGRLRDLIPNVCLQMLLRGRNLLGYEPYPDEAVRAFVFEAVDAGVDIFRIFDALNNVEPMRAAISATVEAGAVAEGAICYTGDLLDPGERLYTLDHYLHVAEQLVEAGVHILAIKDMAGLLRAPAAAQLVTRLRREFDLPVHLHTHDTAGGQLATYLAAIEAGVDAVDGAAASMAGMTSQPSLASIVAATDHTARATGIALESLLELEPYWEAVRTTYAPFESGLRAPTGRVYRHQIPGGQLSNLHQQAGALGLGNRFEEVELAYERANALLGDIIKVTPTSKVVGDLALFVVSAGIDWDELAAQPERFDLPASVIQLLRGDLGEPAGGFPQPFTERALRGAARDSRDGSALEPEMRTRLAEAGNDRRTALAELQFPGPTQERRDAYERYGDVTPVPTRPFLYGLPDDGEVSIDLGPGVRLIYALEAIGEPDDRGMRSVLVRVNGQLRPIDVRDESVEAPTSKVERADPANDSHVAAPLTGVVTVRVKEGDEVSEGQPLAMLEAMKMESTVTSPAAGTVQRVPVPSGTRLEQGDLIAVIEQS

SEQ ID NO: 280 - DNA, 3378 bp, Unknown
  pyc_20 sequence from unknown bacterial species from environmental sample
atgttctcgaaggtgctcgtggccaaccggggcgagatcgccatccgggcgttccgggctgcctacgagctcggtgctcgcacggtggcggtcttccccaacgaggacaggtggtccgagcaccgcctcaaggccgacgaggcctacgagatcggccagcgaggccacccggtccgcgcctacctcgacccggacgcgatcgtcgcggtcgccgtacgttcgggtgccgacgcggtctaccccggctacggcttcctgtcggagaaccccaggctggccgaggcctgcgccaacgccggcatcaccttcgtcggcccgacggccgaggtgctcaccctcaccggcaacaaggcccgggcgatcgcggcggcccacgaggccggcgtacccacactggcctcggtgccgccgagccaggacgccgacgagctggtcgccacggccggcgagctgccctacccgctcttcgtcaaggcggtcgccggcggcggcgggcgcggcatgaggcgggtcgacgagcccgcgcagctgcgcgcggccatcgagacgtgcatgcgcgaggccgagggcgccttcggcgatgcgaccgtgttcgtcgagcaggcggtggtcgacccacggcacatcgaggtgcagatcctcgcggacaggcaaggcaacgtcatccacctcttcgagcgcgactgctcagtgcagcgccgccaccagaaagtggtcgagatcgcaccggcccccaacttcgaccccgagctgcgggagcggatctgcgccgacgcggtgaggttcgcgcgccacatcggctaccagaacgccggcacggtcgagttcctcgtcgaccccggtggcagctacgtcttcatcgagatgaacccccgcatccaggtcgagcacaccgtgaccgaggaggtcaccgacgtcgacctcgtgcagtcgcagctgcggatcgcctcgggagagacgctccaggacctcggcctgcgccaagactcgatcgtgctgcgcggcgccgcgctccagtgccggatcacgaccgaggaccctgccaacaacttccggcccgacaccggccggatcacgacgtaccgctcccccggcggcgccggcatccgcctcgacggcggcacgacctacaccggcgccgaggtcagcccgcacttcgactcgatgctggccaagctcacctgccggggccgcacgttcgagaaggccgtcgaacgggcccgccgggcggtcgcggagttccggatccgcggggtgtcgaccaacatcgcgttcctgcaggcgctgctcgacgaccctgacttccgtgccggccgggtgaccacgtcgttcatcgagacgcaccccgagctgctcaccgcgcgcgcgagcggcgaccgcggcaccaagctgctcacctacctcgccgacgtcaccgtcaaccagccacacggcccagcgccggtgagcctcgacccggtcagcaagctccccgaggtcgacctcaaggtgcccgcgcccgacggcacccgccagtcgttgctggccctcggacccgctgcgttcgcgcaggcgcttcgcgaccagggccgggttgccgtcaccgacacgaccttccgcgacgcccaccagtccctgctggccacccgggtgcggacccgcgacctgctcgccgtcgcgggtcatgtcgcgcggacgaccccgcagctgtggtcgctcgaggcgtggggcggagcgacgtacgacgtggcgctgcggttcctgtccgaggacccgtgggagcggctggccaagctccgccaggccacaccgaacatctgcctccagatgttgctgcgcgggcgcaacacggtcggctacacgccgtacccgaccgacgtcaccaccgccttcgtcgaggaggccgcggccaccgggatcgacgtcttccgcatcttcgacgccctcaacgacgtcgagcagatgcggccggccatcgaggccgtgctggcgaccggcaccagcgtcgcggaggtcgctctctgctacaccggcgacctgtccgaccctcgcgagaggctctacacgctcgactactacctcggcctggcatcgcggatcgtggagtccggcgcacatgtgctggcgatcaaggacatggccggtgtgctgcgggctccggccgcccgaaggctggtgaccgcgctgcgctcggagttcgacctgccggtgcacctgcacacccacgacacccccggcggccagctggctacgctgctggccgcgatcgaagcaggggtcgacgccgtcgacgcggccaccgcgtccatggccggcaccacctcgcagccgccgctctcggcgctggtgtccgcgaccgaccactcgccgcgcgagaccggtctctcgctcgacgcggtgggtgcgctggagccctactgggaggccgtgcgccgcgtctacgcgccgttcgagtcggggctgcccgcgcccaccggccgcgtctacacccacgagatccccggtgggcagctctccaacctgcgccagcaggcgatcgcgctcggcctcggcgagaagttcgagcagatcgaggacatgtacgccgcggccgaccgcatcctcggccacatcgtcaaggtgaccccgtcgtccaaggtcgtcggcgacctggcgctgcacctcgtcgcggtcggtgccgacccggcggagttcgcggccaaccctcagaagttcgacatccccgcctcggtcatcggcttcctccacggcgagctgggcgacccgcccggcggctggccggagccgttccggtcgcgcgcgatcgaggggcgggcgtgggagccgccctcgggctcgctcaccgacgaccagcgcgccggcctgcgcgacaaccgccgcgagaccctcaacgagctgctgttcccagggccgaccaagcagttccgcgagatccgggcgacgtacggcgacgtgtcggcgctctcctcgatcgactacctctacggcctgcgtcagggggtcgagcaccaggtcgagctcgacgagggcgtgacgatcttcctcgggctccaggcgatctccgaccccgacgaacgcggcttccgtaccgtgatggcgctgatcaacggccagctacggccgatcagcgtgcgcgaccgcagcgtctccacggccgtcgccgccgccgagaaggcggaccactctgacccgagccatgtcgcggcgccgttccagggtgcggtgacggtggtcgtcgagaagggcgaggaggtcgaggcaggccagaccgtcgccacgatcgaggcgatgaagatggaggccgcgatcaccgctccccgcgccggcaccgtcgagcgcctggccttcgccggcacccagaccgtcgacggaggcgacctggtgctggtcctcggctga

SEQ ID NO: 281 - protein, 1125 aa, Unknown
  pyc_20 sequence from unknown bacterial species from environmental sample
MFSKVLVANRGEIAIRAFRAAYELGARTVAVFPNEDRWSEHRLKADEAYEIGQRGHPVRAYLDPDAIVAVAVRSGADAVYPGYGFLSENPRLAEACANAGITFVGPTAEVLTLTGNKARAIAAAHEAGVPTLASVPPSQDADELVATAGELPYPLFVKAVAGGGGRGMRRVDEPAQLRAAIETCMREAEGAFGDATVFVEQAVVDPRHIEVQILADRQGNVIHLFERDCSVQRRHQKVVEIAPAPNFDPELRERICADAVRFARHIGYQNAGTVEFLVDPGGSYVFIEMNPRIQVEHTVTEEVTDVDLVQSQLRIASGETLQDLGLRQDSIVLRGAALQCRITTEDPANNFRPDTGRITTYRSPGGAGIRLDGGTTYTGAEVSPHFDSMLAKLTCRGRTFEKAVERARRAVAEFRIRGVSTNIAFLQALLDDPDFRAGRVTTSFIETHPELLTARASGDRGTKLLTYLADVTVNQPHGPAPVSLDPVSKLPEVDLKVPAPDGTRQSLLALGPAAFAQALRDQGRVAVTDTTFRDAHQSLLATRVRTRDLLAVAGHVARTTPQLWSLEAWGGATYDVALRFLSEDPWERLAKLRQATPNICLQMLLRGRNTVGYTPYPTDVTTAFVEEAAATGIDVFRIFDALNDVEQMRPAIEAVLATGTSVAEVALCYTGDLSDPRERLYTLDYYLGLASRIVESGAHVLAIKDMAGVLRAPAARRLVTALRSEFDLPVHLHTHDTPGGQLATLLAAIEAGVDAVDAATASMAGTTSQPPLSALVSATDHSPRETGLSLDAVGALEPYWEAVRRVYAPFESGLPAPTGRVYTHEIPGGQLSNLRQQAIALGLGEKFEQIEDMYAAADRILGHIVKVTPSSKVVGDLALHLVAVGADPAEFAANPQKFDIPASVIGFLHGELGDPPGGWPEPFRSRAIEGRAWEPPSGSLTDDQRAGLRDNRRETLNELLFPGPTKQFREIRATYGDVSALSSIDYLYGLRQGVEHQVELDEGVTIFLGLQAISDPDERGFRTVMALINGQLRPISVRDRSVSTAVAAAEKADHSDPSHVAAPFQGAVTVVVEKGEEVEAGQTVATIEAMKMEAAITAPRAGTVERLAFAGTQTVDGGDLVLVLG

SEQ ID NO: 282 - DNA, 3405 bp, Unknown
  pyc_21 sequence from unknown bacterial species from environmental sample
atgttcgccaaggtgctggtcgccaaccgcggtgagatcgctgtccgggccttccgtgccgcgtacgagctgggcgtgaagacggtagcggtctttccctatgaggaccgtaacgctgtgcaccggatcaaggcggatgaggcctacatgatcggcgagcgtggccatccggtacgcgcttacctggatatcgcagagatcatccgggccgctaaggagtccgaggccgatgcgatctaccccggctatggattcttgagcgagaatcctggcctggcccaggcctgcgacgaggcgggcatcgtcttcatcggcccgcccgccggggttctcgagcttgccggcaacaaggtccgtgccattgaagcagccagggcggctggcgtccccaccctcaagtccacacctccttcggcagaccttgatgagctggtgcccgccgccgaggagatcggctttccggtgttcgtcaaggcggtcgccggcggcggcggtcgcggtatgcgccgggtcgatgaccccaagatgcttcgggaatccataactgcagcgatgcgcgaggctgaaggcgcgttcggcgatcccaccgtgtacatcgagcaggcggttgggcgcccgcgccacatcgaggtacagatccttgccgatacccagggccacaccatccatctgttcgagcgtgactgctcggttcagcggcggcaccagaagattgttgagattgcgcccgcgcagaacatctcgaccgagttgcgggaggcattgtgccgtgacgcggtgcgctttgccgagtcgatcaacttctcatgtgcgggaactgttgagttcttggtcgaaactgaaggacagcgtgccggtcagcacgtcttcatcgagatgaatcctcggattcaggttgagcacccggtcaccgaagagatcaccgacgttgatcttgtgcaggcccagatgcgcattgccgccggggagagcctgagtgatcttggtctggcccaggatgtgatcaggatcaacggtgcggcactgcagtgtcggatcacgaccgaggacccggcgaacggctttcggcccgacaccggcacgatcactgcctaccgctccgccggtggcgcgggcgtacgcctcgacggtggcaccatcgacatcggggtggagatcagcgcgtacttcgattcgttgctggtcaagctcatttgccgcggccggacattcgagcaggctgtggctcgggctcagcggaccttggctgagttccggattcgtggagtcagcaccaacattcctttcctgcaatcggttttggaggatccggacttcattgccggcgatatctcgacctccttcattgacgagcggcccgacctgctgaccgcccatgctccggcggaccgcggtaccaagctgttgcgctggctggctgaggtaacggtcaaccagccgcatggcccggcaccgacgcagctcgacccaggcgttaaacgacctaccggcgtcgatctcaacgtcccgtcgcccccgggctcgcggcagcgtcttcttgatcttggtccagaagccttcgctgccgacctgcggcaacgggtcccgatcgaggtcaccgacacgaccttccgggacgcccatcagtcgttgctggctacccgggtccgtaccaaagacctcatcaggatcgcgccatacgtcggccggatgacgccggaactgctgtcggtcgaatgctggggcggggcgacctatgacgtagcgcttcgcttcatttccgaggatccttgggaacgcctggccgcgctgcgctacaacatgccgggcctgtgcctgcagatgttgctgcgcggtcgcaacacggttggctatacgccatacccgaccaaggtcacgacctccttcgtggccgaggctgccgaggttggcatcgacatcttccggatcttcgatgcgctcaacgacgtcgagcagatgcgtccagcgatcgaggcggtgcgcgagacaggcagcaccattgccgaggtggctctgtgctacaccggcgatctgaactcaccggctgaggatctctacacgctcgactactacttgcgtttggccgagaagatcgtgaacgcgggggcgcacgtgctcgggatcaaggacatggccggcctgctccgcccaccagcggcccggaagctcgtcgccgcactgcgagacaactttgatctgccggtgcacttgcatacccacgacaccgcaggtggtcagcttgcgaccttgttagccgccatcgatgtgggtgttgatgcggttgacgtggccagcgccccgatggccgggacgaccagccaggtgccggcgtcggccctggtggcagcctgcgcgaacaccgagcggccgaccaaccttgatctgcgcgccgtgatggaactggagccgtactgggaagcggtgcgcagggtgtacgcacccttcgagtcagggttgcccagtccgacgggccgggtttacgaccacgagattccgggagggcagctctccaacctccgccagcaggcgatcgctctcgggctgggggagaagtttgagcagatcgaggcgatgtacaccgcggcgaatgcaattttgggcaggccgcccaaggtcaccccgtcgtcgaaggtggtcggcgatctggcacttcacctggtcgcggtcggcgcggacccggacgacttcgctgagaacccgcagagctacgacatcccggattcagtgatcggctttctcaatggggaactgggcgatccgcctggcggctggccggaaccattccggaccaaagcgctgcaggggcggaccgtgccggtccgcgatgtggagctctcaccggaagattcagctgatcttgatgacaagggccaggtccgccaggccacgttgaaccgcctgctgtttcctgggccgaccaaggagttcctggccaaccgagcaacctacggcgacgtcgcccggctcaatactctcgacttcctctacgggttgcagcccggccaggagcatgtcgccaagatcggtaaaggtgtcagcctgattctcgggctggcggcgatcggtaacgccgacgagcgaggcatgcgcaccgtgatgtgtacgctcaacgggcagttgcggccgctccgggtgcgcgacaagtcgatcaaggtcgatgtcaagactgccgaacgcgcggatcccaccaagccgggtcatgtcgccgctccgttcgccggggtggtcaccgtcaccgtcaacgaaggcgacacagtcgagaccggtgcaacggtagcaaccatcgaagccatgaagatggaggccgccatcaccgcgccggtctcaggtgtggtgcagcgattggcgatcgcagcagtgcagcaggtggagggcggcgacctcctgctcgtcatcgcggtctag

SEQ ID NO: 283 - protein, 1134 aa, Unknown
  pyc_21 sequence from unknown bacterial species from environmental sample
MFAKVLVANRGEIAVRAFRAAYELGVKTVAVFPYEDRNAVHRIKADEAYMIGERGHPVRAYLDIAEIIRAAKESEADAIYPGYGFLSENPGLAQACDEAGIVFIGPPAGVLELAGNKVRAIEAARAAGVPTLKSTPPSADLDELVPAAEEIGFPVFVKAVAGGGGRGMRRVDDPKMLRESITAAMREAEGAFGDPTVYIEQAVGRPRHIEVQILADTQGHTIHLFERDCSVQRRHQKIVEIAPAQNISTELREALCRDAVRFAESINFSCAGTVEFLVETEGQRAGQHVFIEMNPRIQVEHPVTEEITDVDLVQAQMRIAAGESLSDLGLAQDVIRINGAALQCRITTEDPANGFRPDTGTITAYRSAGGAGVRLDGGTIDIGVEISAYFDSLLVKLICRGRTFEQAVARAQRTLAEFRIRGVSTNIPFLQSVLEDPDFIAGDISTSFIDERPDLLTAHAPADRGTKLLRWLAEVTVNQPHGPAPTQLDPGVKRPTGVDLNVPSPPGSRQRLLDLGPEAFAADLRQRVPIEVTDTTFRDAHQSLLATRVRTKDLIRIAPYVGRMTPELLSVECWGGATYDVALRFISEDPWERLAALRYNMPGLCLQMLLRGRNTVGYTPYPTKVTTSFVAEAAEVGIDIFRIFDALNDVEQMRPAIEAVRETGSTIAEVALCYTGDLNSPAEDLYTLDYYLRLAEKIVNAGAHVLGIKDMAGLLRPPAARKLVAALRDNFDLPVHLHTHDTAGGQLATLLAAIDVGVDAVDVASAPMAGTTSQVPASALVAACANTERPTNLDLRAVMELEPYWEAVRRVYAPFESGLPSPTGRVYDHEIPGGQLSNLRQQAIALGLGEKFEQIEAMYTAANAILGRPPKVTPSSKVVGDLALHLVAVGADPDDFAENPQSYDIPDSVIGFLNGELGDPPGGWPEPFRTKALQGRTVPVRDVELSPEDSADLDDKGQVRQATLNRLLFPGPTKEFLANRATYGDVARLNTLDFLYGLQPGQEHVAKIGKGVSLILGLAAIGNADERGMRTVMCTLNGQLRPLRVRDKSIKVDVKTAERADPTKPGHVAAPFAGVVTVTVNEGDTVETGATVATIEAMKMEAAITAPVSGVVQRLAIAAVQQVEGGDLLLVIAV

SEQ ID NO: 284 - DNA, 3096 bp, Unknown
  pyc_22 sequence from unknown bacterial species from environmental sample
gtgtggcacgacagagacgtcgccgacaccatggtgttcgtcaccggcaggctgaagggatccggaatgttccgcaaggtgctggtcgccaaccgtggggagatcgcgattcgcgcgttccgcgccggttacgaactgggtgcgcgcacggtcgccgtcttcccgcacgaggaccgcaactcgctgcaccggctcaaggccgacgaggcatacgagatcggcgagccgggccacccggtgcgggcctacctgtccgtggaggagatcatccgggcggcacgtctggccggtgcggacgcggtctacccggggtacgggttcctgtccgagaacccggcactggcccgtgcctgcgaggaggcgggcatcacgttcgtggggccggacatgcggaccctggagctgaccgggaacaaggcgcgtgccgtggccgccgcccgcgaggccggcgtacccgtgctgggctcgtcggagccctccaccgacgtggacgaactggtcgcggccgccgagggcatcggcttcccggtgttcgtcaaggccgtcgccggcggcggcggacgcggcatgcggcgcgtcgaggacccctcgacgctgcgtgagtccatcgaggcggcggcccgtgaggccgcatccgcgttcggcgaccccaccgtcttcctggagaaggccgtcgtcgacccccggcacatcgaggtgcagatcctcgccgacgggcagggcgacgtcatccacctcttcgagcgcgactgctcggtgcagcgccgccaccagaaggtgatcgaactcgcgcccgccccgaacctcgacccggcactgcgcgagcgcatctgcgacgacgccgtcaagttcgcccgccggatcggctaccgcaacgcgggcaccgtggaattccttctcgaccgcgacggcaaccacgtcttcatcgagatgaacccgcgcatccaggtcgagcacacggtgaccgaggaggtgaccgacgtcgacctggtgcaggcgcagctgcgcatcgccgccggcgagacgctggccgacctcggcctgacgcaggacgccgtcgtcctgcgcggcgccgcgctgcagtgccggatcaccaccgaggacccggccaacggcttccgcccggacaccggcatgatcagcgcgtaccgctcgccgggcggttcgggcatccgcctcgacggcggcaccacccacgccggtacggaggtcagcgcccacttcgactcgatgctggtcaagctgacctgccggggaagggacttcaggaccgcggtcagccgtgcccggcgcgcggtggccgagttccgcatcaggggcgtgtccacgaacatcccgttcctgcaggctgtgctcgacgacccggacttccgggccggccacgtcacgacctccttcatcgagcagcggccgcacctgctcaccgcgcgccactccgccgaccgcggcacgaagctgctcacctacctcgccgacgtcacggtgaacaagccccacggcccgcggcccgacctgatcgcgccgaccaccaagctgccaccgctgcccgccaccgagccgccggccggctcccggcagcagctcaccgcgctcggcccggagggcttcgcacgccggctgcgcgagtcgccgaccatcggcgtcaccgacaccaccttccgggacgcccaccagtcgctgctcgccacccgggtccggaccaaggacctgctcgccgtcgcccctgtggtggcgcgcaccctgccgcagctgctgtccctggagtgctggggcggcgccacctacgacgtcgccctgcgcttcctcgcggaggacccctgggagcgcctggccgcgctgcgcgaagccgtaccgaacatctgcctccagatgttgctgcgcggccgcaacaccgtgggctacaccccgtacccgaccgaggtgacggacgccttcgtgcaggaggcggccgccaccggaatcgacatcttccgtatcttcgacgcgctcaacgacgtcggacagatgcggcccgccatcgacgccgtacgcgagaccgggtcggcggtcgccgaggtggcgctgtgctacaccggcgacctgtccgatccgtcggaacggctctacaccctggactactacctccggctggccgaggagatcgtggccgcgggtgcccacgtcctggccgtcaaggacatggccgggctgctccgcgccccggccgccgccacgctggtgtccgcgctgcgcagggagttcgacctgccggtgcacctgcacacgcacgacaccgcgggcggccagctcgccacctacctcgcggcggtccaggccggtgcggacgccgtggacggggcggtggcctccatggcgggcaccacctcgcagccgtcgctgtcggcgatcgtcgccgcgaccgaccacaccgagcggccgacgggactcgacctccaggcggtcggcgacctggagccgtactgggagagcgtccgcaggatctacgcaccgttcgaggccggtctcgcctcgccgaccgggcgcgtgtaccaccacgagatccccggcggccagctctccaacctccgcacccaggcgatcgcactcggactcggcgaccgcttcgaggaggtcgaggcgatgtacgccgccgcggacaggatgctcggccggctggtgaaggtcaccccgtcctcgaaggtggtcggcgatctcgcgctgcacctcgtgggcgccgccgtgtccccggaggacttcgaggcggagcccggcaggttcgacatcccggactcggtcatcggcttcctgcgcggtgaattgggcaatccgccgggcggctggcccgagccgttccgcagcaaggcgctggcgggccgcgccgagcccaagccggtgcgggagctgaccgcggaagaccgcaccggcctcgagaaggaccggcggacgacgctcaaccggctgctgttccccggaccggcgaaggagttcgagacacaccgtcagacctacggcgacaccagcgtgctcgacagcaaggacttcttctacgggctgcgccccggaaaggagtacgccgtcgacctcggaccgggcgtgcggctgctcatcgagctggag

SEQ ID NO: 285 - protein, 1032 aa, Unknown
  pyc_22 sequence from unknown bacterial species from environmental sample
VWHDRDVADTMVFVTGRLKGSGMFRKVLVANRGEIAIRAFRAGYELGARTVAVFPHEDRNSLHRLKADEAYEIGEPGHPVRAYLSVEEIIRAARLAGADAVYPGYGFLSENPALARACEEAGITFVGPDMRTLELTGNKARAVAAAREAGVPVLGSSEPSTDVDELVAAAEGIGFPVFVKAVAGGGGRGMRRVEDPSTLRESIEAAAREAASAFGDPTVFLEKAVVDPRHIEVQILADGQGDVIHLFERDCSVQRRHQKVIELAPAPNLDPALRERICDDAVKFARRIGYRNAGTVEFLLDRDGNHVFIEMNPRIQVEHTVTEEVTDVDLVQAQLRIAAGETLADLGLTQDAVVLRGAALQCRITTEDPANGFRPDTGMISAYRSPGGSGIRLDGGTTHAGTEVSAHFDSMLVKLTCRGRDFRTAVSRARRAVAEFRIRGVSTNIPFLQAVLDDPDFRAGHVTTSFIEQRPHLLTARHSADRGTKLLTYLADVTVNKPHGPRPDLIAPTTKLPPLPATEPPAGSRQQLTALGPEGFARRLRESPTIGVTDTTFRDAHQSLLATRVRTKDLLAVAPVVARTLPQLLSLECWGGATYDVALRFLAEDPWERLAALREAVPNICLQMLLRGRNTVGYTPYPTEVTDAFVQEAAATGIDIFRIFDALNDVGQMRPAIDAVRETGSAVAEVALCYTGDLSDPSERLYTLDYYLRLAEEIVAAGAHVLAVKDMAGLLRAPAAATLVSALRREFDLPVHLHTHDTAGGQLATYLAAVQAGADAVDGAVASMAGTTSQPSLSAIVAATDHTERPTGLDLQAVGDLEPYWESVRRIYAPFEAGLASPTGRVYHHEIPGGQLSNLRTQAIALGLGDRFEEVEAMYAAADRMLGRLVKVTPSSKVVGDLALHLVGAAVSPEDFEAEPGRFDIPDSVIGFLRGELGNPPGGWPEPFRSKALAGRAEPKPVRELTAEDRTGLEKDRRTTLNRLLFPGPAKEFETHRQTYGDTSVLDSKDFFYGLRPGKEYAVDLGPGVRLLIELE

SEQ ID NO: 286 - DNA, 3378 bp, Unknown
  pyc_23 sequence from unknown bacterial species from environmental sample
atgttccgcaaggtgctggtcgcgaaccgcggggagatcgccatccgcgcgttccgcgcagcgtacgagctgggcgtgtcgacggtggcggtgttcccgcacgaggaccgcagctcgctgcatcgagccaaggccgacgagtcgtaccagatcggcgagccgggccacccggtgcgggcatacctgtcggtcgaggaagtcatcaaggccgcgcggaaggccggagcggacgcgatctaccccgggtacggcttcctgtcggagaaccctgatctcgcggaggcctgcgagcgcgagggcatcacgttcgtgggtccgtccgccgaggtactgcacctcaccggcaacaaggcgcgcgcggtggcggccgcccgggaggcgggcatcccggtgctgcgctcgtcggcgccgtccgacgacgtcgacacactgctcgccgcggcggacgggatcgacttcccgatcttcgtcaaggccgtcgccggcggcggcgggcgcggcatgcggcgggtgaccgcgcccggcgagctgcgcgaggccgtcgaggcggcgatgcgggaggccgaatcggcgttcggcgaccgaaccgtcttcctcgaacaggcggtggtgaacccccgccacatcgaggtgcagatcctcgccgacgccgcgggcaacgtcgtgcacctctacgagcgcgactgctcggtgcagcgccgccatcagaaggtcatcgagatcgcgcccgcgcccaacctcgaccccgagctgcgcgagcggatctgctccgacgccgtggccttcgcccgccacatcggctacgtcaacgcgggcaccgtcgagttcctgctcgacgagcgcggcaaccacgtgttcatcgagatgaacccgcgcatccaggtggagcacacggtcaccgagcaggtcaccgaccgcgacctcgtgatcgcccagctgcgcatcgcgtccgggatgacgctgccgcagttgcggctgaaccaggaggacgtgacgctgaacggcgccgcgctgcagtgccgcgtcaccacggaggatccgaccaacggcttccgccccgacaccggcacgatcagcgcctaccgctcgccgggtggccccggcgtccggctggacggtggcaccacgcacaccggcgccgaggtgagcgcccacttcgactcgatgctggtgaagctcacctgctacggccacgacttctcgaacgccgtgcgcagggcgcggcgggcgatcgcggagttccggatccgcggcgtgtcgacgaacctgccgtacctcgccgctgtactcgacgacccggacttcgcggccggccggatcaccacgagcttcatcgacgagcgcccccacctgctcaccgcgcgcaagcctgccgaccggggcacccgggtactcagctacctcgccgacatcacggtcaacaagccgaacgggccgaggccgcaggtcgtcgaggcggtggacaagctgccccgctgcgacctggacgcccccgccccggacggctcccggcagctactgcgcgagctgggtcccgaaggtttcgcgcggtggttgcgtgagcagacgaccgtgccggtcactgacaccacgttccgcgacgcgcaccagtcgctgctcgcgacgcgggtgcggacccgggacctgctcgcgatcgccccgcatatggcccgcatggcaccacagctgctctccctcgagtgctggggcggcgcgacctacgacgtggcgctgcggttcctcgccgaggacccgtgggagcggctggccgcgctcagcgccgcggtgccgaacatctgcacgcagatgctcctgcgcgggcgcaacaccgtgggctacacgccgtaccccaccgaggtgaccgacgccttcgtcgaggaggcggcgcgtaccgggatggacatcttccggatcttcgacgccctcaacgacgtcgagcagatgcgcccggccatcgacgccgtgcgcgccacgggcaccgccgtcgccgaggtggcgctctgctacaccgccgacctgtccgaccccgccgagcagctctacacgctggactactacctgcggctggccgagcagatcgtcgaggcaggtgcccacgtcctcgcgatcaaggacatggccgggctgcttcgcccgcccgcggcccgcgcgctggtcacggcgctgcgcgagcgcttcgacctgccggtgcacctgcacacccacgacacggcgggcgggcagctcgccacgctggtcacggcgatcgacgcgggcgtggacgccgtcgacgcggcagtcgcgtccatggcaggaacgacgagccagccgtcgctctccgcgctggtcgcggccaccgaccacaccgaccgcaccaccggcctctcgctggaggcggtcggcgacctggagccgtactgggaggccgtgcggaaggtgtacgcgccgttcgaggcggcattgccgtcgccgaccgggcgcgtctaccaccacgagatccccggcgggcagctgtccaacctgcgccagcaggcgatcgcgctcgggctcggcgaccggttcgagctgatcgaggactgctacgcggccgcggaccggatgctcgggcggctggtgaaggtgaccccgtcgtcgaaggtggtgggcgacctcgcgctgcacctcgtcggcgccggggtggaacccaaggacttcgaggccgacccgggccagttcgacgtgcccgactcggtgatcgggttcctgcgcggtgagctgggcgacccgccaggcggctggcccgagccgttccgcagccgcgctctcgaggggcgcccggcggcgaaggagggcgcgggcctctccgacgaggatcgggcgggcctgcgggacgatcgccgggcgacgctcaaccgactgctgttcccggggccggcgaaggagttcctcgcccaccgcgaggcttacagtgacacctccgtgctctcgacgaaggacttcctctacggcctggagcccgacatcgagcacatcgcacagctggagccaggcgtcgcgctgctcatcgagctggaggcgatctccgagcccgacaagcggggctaccgcaacgtgctcgccaccttgaacggccagatgcggccggtgtcggtgcgcgaccggtcgatcgtgagcgacgtcaaggccgccgagagggccgaccggtcgaacccgaagcacgtggcggcgccgttcgccggggtcgtgacgctgcaggtcggcgagggcgaccgggtcgaggacggccagaccgtcgccaccatcgaggcgatgaagatggaggcctcgatcaccgcgcaccaggcgggcacggtcgggcggctcgcgatcggcaaggtacagcaggtcgagggcggtgacctgctgctggtgctcgagtga

SEQ ID NO: 287 - protein, 1125 aa, Unknown
  pyc_23 sequence from unknown bacterial species from environmental sample
MFRKVLVANRGEIAIRAFRAAYELGVSTVAVFPHEDRSSLHRAKADESYQIGEPGHPVRAYLSVEEVIKAARKAGADAIYPGYGFLSENPDLAEACEREGITFVGPSAEVLHLTGNKARAVAAAREAGIPVLRSSAPSDDVDTLLAAADGIDFPIFVKAVAGGGGRGMRRVTAPGELREAVEAAMREAESAFGDRTVFLEQAVVNPRHIEVQILADAAGNVVHLYERDCSVQRRHQKVIEIAPAPNLDPELRERICSDAVAFARHIGYVNAGTVEFLLDERGNHVFIEMNPRIQVEHTVTEQVTDRDLVIAQLRIASGMTLPQLRLNQEDVTLNGAALQCRVTTEDPTNGFRPDTGTISAYRSPGGPGVRLDGGTTHTGAEVSAHFDSMLVKLTCYGHDFSNAVRRARRAIAEFRIRGVSTNLPYLAAVLDDPDFAAGRITTSFIDERPHLLTARKPADRGTRVLSYLADITVNKPNGPRPQVVEAVDKLPRCDLDAPAPDGSRQLLRELGPEGFARWLREQTTVPVTDTTFRDAHQSLLATRVRTRDLLAIAPHMARMAPQLLSLECWGGATYDVALRFLAEDPWERLAALSAAVPNICTQMLLRGRNTVGYTPYPTEVTDAFVEEAARTGMDIFRIFDALNDVEQMRPAIDAVRATGTAVAEVALCYTADLSDPAEQLYTLDYYLRLAEQIVEAGAHVLAIKDMAGLLRPPAARALVTALRERFDLPVHLHTHDTAGGQLATLVTAIDAGVDAVDAAVASMAGTTSQPSLSALVAATDHTDRTTGLSLEAVGDLEPYWEAVRKVYAPFEAALPSPTGRVYHHEIPGGQLSNLRQQAIALGLGDRFELIEDCYAAADRMLGRLVKVTPSSKVVGDLALHLVGAGVEPKDFEADPGQFDVPDSVIGFLRGELGDPPGGWPEPFRSRALEGRPAAKEGAGLSDEDRAGLRDDRRATLNRLLFPGPAKEFLAHREAYSDTSVLSTKDFLYGLEPDIEHIAQLEPGVALLIELEAISEPDKRGYRNVLATLNGQMRPVSVRDRSIVSDVKAAERADRSNPKHVAAPFAGVVTLQVGEGDRVEDGQTVATIEAMKMEASITAHQAGTVGRLAIGKVQQVEGGDLLLVLE

SEQ ID NO: 288 - DNA, 3384 bp, Unknown
  pyc_24 sequence from unknown bacterial species from environmental sample
gtgatctcgaaagtcctggttgccaaccgcggcgagatcgccatccgcgcctttcgcgccgcctacgagttgggcatcacgaccgtggccgtctaccccttcgaggaccgcaattcccaacaccggctcaaggccgacgagtcctaccagatcggcgagaagggccacccggtgcgtgcctacctgtcggtcgacgagatcgtctcgaccgcgcgccgcgccggcgccgacgccgtctaccccggctatggcttcctgtcggagaatcccgagctggccgaggcttgcgcggcagcgggcatcaagttcatcggcccgagcgcggcgatcctggagctgaccggcaataagtcccgggccatcggggaggcgcgcgccgccgggttgccggtgctgaactcgtcggcgccgtcgtcgtcggtgtacgaactgcttgccgccgcccaaaacatgccattcccgctgttcgtcaaggcggtgtctggtggcggcgggcgcggcatgcgccgggtgaatgaccctgacgccttgcgtgaggcgatcgaggctgccagccgcgaggccgagtcgtcgttcggcgacccgagcgtgtacctcgagcaggccgtgcgcaacccacgccacatcgaggtacagatcctggccgacgctcacggcaacgtgatgcatctcttcgagcgcgactgcagcgtgcagcgacggcatcagaaggtgatcgagctggcgcctgcgccgaacctgccgacggagctgcgcgagaagatctgcgccgacgccgtcgcgttcgcacgccggatcaactacacgtatgcgggaaccgtcgagttcctgcttgacgagcgtggacactacgtgttcatcgagatgaacccgcgcatccaagtcgagcacacggtcaccgaagaggtcaccgacgttgacctggtggcaagccagatgcgcatcgccgacggtgagaccctcgaagatcttggcttgaaccaggattcgctgcgcacgcgcggtgcggcgttgcagtgccggataaccaccgaggacccggccaacgggttccgacccgacacgggccgcatcaccggctaccgctctgcgggcggtgccggcatccggctggacggcgcggcgaacctgggcgccgagatcggtgcgcatttcgattcgatgctggtgaagctcacctgccggggccgcgacttcgccacggcggtcgcccgtgctcggcgcgcgctcgctgagttccgggttcgcggggtatcgacgaacatcccgttcctgttggccgtggtcaccgactcagattttcgggccggtcggatcaacacgtcgttcatcgacgagcgcccctacctgttgaccgcacgcacaccggcggaccgaggcaccaagatcctgaactacttggccgacgtcacggtcaaccagccgcacggcacccgtcagtcgacggcgtatccccaggacaagcttccgcagatcgatctgtcggcgccgccgccggccggctccaagcaactgctcaccgagctcggcccggagggattcgctcgccggctgcgcgagtcacccgccgtcggcgtcaccgacacgacgttccgcgatgcccatcagtcgctgctggccacccgaatccgcacgacggggctgctgatggttgcgccgtacatcgccaggatgatcccgcagctgttgtcgatcgaatgctggggtggcgcgacttatgatgtggcactgcggtttttgaaggagaacccgtgggagcggctggccgcgctgcgtgaggcggtgcccaacatctgcctgcagatgctgctgcgcgggcgcaacacggtgggctacaccccgtatccggagtcggtcacgacggccttcatcgaggaagccacggccaccggtgtcgacatctaccggatcttcgacgccctcaacaacgtggagtcgatgcggccggctatcgacgcggtgcgcgaaaccggcacggcgatagccgaagtcgcgatgagctacaccggcgacctgtccgacccgggcgagaggctttacacgctggattactacctcaagcttgccgagcagatcgtggacgccggcgcacatgtgctggccatcaaggacatggctgggctgctaaaagcgccggcggcaacggctttggtcggcgcgctgcgcagccgtttcgacctgccggtgcacgtgcacacccacgacacccccggcgggcaactggccacgtactgggcggcgtggcatgccggtgccaacgcggtcgacggcgcctccgcgccgctggccggcacgacgagccagcccgcgctgtcgtcgatcgtggcggccgcggcgaacaccgaatacgacacaggcctggcgctctccgcggtgtgcgagctggagccgtactgggatgccctgcgaaaggtctacgcgcccttcgagtccggactacccgcgccgaccgggcgcgtgtacaaccacgagatccccgggggccagttgtcaaatctgcgtcagcaggcgatcgccctggggttcggtgaccggttcgaggagatcgaggcgaattacgctgcggccgaccgcatcctgggtcggctggtcaaggtcacgccgtcgtcgaaggtggtcggcgaccttgccctagctctggtgggcgccggcgtgagtgccgacgagttcgccgctgacccagcgcgattcgacattcccgactccgtgatcggcttcttgcgcggagagctgggcgatccgcccggcggctggccggagccattgcgcaccaaggccctagcgggacggccaccggccaagccgcaggtcgcgcttgcaccagatgatgaggcggcgttgacgattcccggctcggagcgtcaatccaccctgaatcgtctgctgttcccgggcccgacaaaggaattcgaagctcaccgcgagctgtacggcgacacgtcgcgcctgtcggccaaccagttcttctacggattgcgccagggcgaagagcaccgggtgaggctggagcgcggcgtagagctgctgatcgggctggaggcgatttccgaccccgacgagcgtgggatgcgcacggtgatgtgcctactcaacggccagctgcggccagtgctggtgcgcgaccgcagcatcgccagcgcggtgcccgccgccgagaaggccgagcgcgcgaaccccgcccacatcgcggcaccattcgccggtgtcgtcaccgtcagcgtggcggagggcggcgaggtggccgccggtcagaccgtcgcgacgatcgaggcgatgaagatggaagccgcaatcaccgcgccgaaggccggaaccgtcgagcgcatcgccgtgtcagagaccgcccaggtcgagggcggcgatctgttgatggtgatcagctga

SEQ ID NO: 289 - protein, 1127 aa, Unknown
  pyc_24 sequence from unknown bacterial species from environmental sample
VISKVLVANRGEIAIRAFRAAYELGITTVAVYPFEDRNSQHRLKADESYQIGEKGHPVRAYLSVDEIVSTARRAGADAVYPGYGFLSENPELAEACAAAGIKFIGPSAAILELTGNKSRAIGEARAAGLPVLNSSAPSSSVYELLAAAQNMPFPLFVKAVSGGGGRGMRRVNDPDALREAIEAASREAESSFGDPSVYLEQAVRNPRHIEVQILADAHGNVMHLFERDCSVQRRHQKVIELAPAPNLPTELREKICADAVAFARRINYTYAGTVEFLLDERGHYVFIEMNPRIQVEHTVTEEVTDVDLVASQMRIADGETLEDLGLNQDSLRTRGAALQCRITTEDPANGFRPDTGRITGYRSAGGAGIRLDGAANLGAEIGAHFDSMLVKLTCRGRDFATAVARARRALAEFRVRGVSTNIPFLLAVVTDSDFRAGRINTSFIDERPYLLTARTPADRGTKILNYLADVTVNQPHGTRQSTAYPQDKLPQIDLSAPPPAGSKQLLTELGPEGFARRLRESPAVGVTDTTFRDAHQSLLATRIRTTGLLMVAPYIARMIPQLLSIECWGGATYDVALRFLKENPWERLAALREAVPNICLQMLLRGRNTVGYTPYPESVTTAFIEEATATGVDIYRIFDALNNVESMRPAIDAVRETGTAIAEVAMSYTGDLSDPGERLYTLDYYLKLAEQIVDAGAHVLAIKDMAGLLKAPAATALVGALRSRFDLPVHVHTHDTPGGQLATYWAAWHAGANAVDGASAPLAGTTSQPALSSIVAAAANTEYDTGLALSAVCELEPYWDALRKVYAPFESGLPAPTGRVYNHEIPGGQLSNLRQQAIALGFGDRFEEIEANYAAADRILGRLVKVTPSSKVVGDLALALVGAGVSADEFAADPARFDIPDSVIGFLRGELGDPPGGWPEPLRTKALAGRPPAKPQVALAPDDEAALTIPGSERQSTLNRLLFPGPTKEFEAHRELYGDTSRLSANQFFYGLRQGEEHRVRLERGVELLIGLEAISDPDERGMRTVMCLLNGQLRPVLVRDRSIASAVPAAEKAERANPAHIAAPFAGVVTVSVAEGGEVAAGQTVATIEAMKMEAAITAPKAGTVERIAVSETAQVEGGDLLMVIS

SEQ ID NO: 290 - DNA, 309 bp, Artificial Sequence
  Strain 331829 gapA truncation
atgaccattcgtgttggtattaacggatttggccgtatcggacgtaacttcttccgcgcaattctggagcgcagcgacgatctcgaggtagttgcagtcaacggcaccaaggacaacaagaccctttccacccttctcaagttcgactccatcatgggccgccttggccaggaagttgaatacgacgatgactccatcaatgaaggtctccggcaacaccgtcaaggttgtttcctggtacgacaacgagtggggctacacctgccagctcctgcgtctgaccgagctcgtagcttccaagctctttag

SEQ ID NO: 291 - DNA, 216 bp, Artificial Sequence
  Strain 331831 gapA truncation
atgaccattcgtgttggtattaacggatttggccgtatcggacgtaacttcttccgcgcaattctggagcgcagcgacgatctcgaggtagttgcagtcaacggcaccaaggacaacaagaccctttccacccttctcaagttcgactccatcatgggcaccaaggacaacaagaccctttccacccttctcaagttcgactcgatctcgaggtag

SEQ ID NO: 292 - DNA, 282 bp, Artificial Sequence
  Strain 331897 gapA truncation
atgaccattcgtgttggtattaacggatttggccgtatcggacgtaacttcttccgcgcaattctggagcgcagcgacgatctcgaggtagttgcagtcaacggcaccaaggacaacaagaccctttccacccttctcaagttcgactccatcatgggccgccttggccaggaagttgaatacgacgatgactccatcaccgttggtggcaagcgcatcgctgtttacgcagagcgcgatccaaagaacctggactgggccgccacaacgttgacatcgtga

SEQ ID NO: 293 - DNA, 102 bp, Artificial Sequence
  Strain 331904 gapA truncation
atgaccattcgtgttggtattaacggatttggccgtatcggacgtaacttcttcgtcgcaggtgccaagaaggtcatcatctcccgatgcaaacgcggctaa

SEQ ID NO: 294 - protein, 334 aa, Artificial Sequence
  GapAv9-L224S (331772)
MTIRVGINGFGRIGRNFFRAILERSDDLEVVAVNGTKDNKTLSTLLKFDSIMGRLGQEVEYDDDSITVGGKRIAVYAERDPKNLDWAAHNVDIVIESTGFFTDANAAKAHIEAGAKKVIISAPASNEDATFVYGVNHESYDPENHNVISGASCTTNCLAPMAKVLNDKFGIENGLMTTVHAYTGDQRLHDASHRDLRRARAAAVNIVPTSTGAAKAVALVLPESKGKLDGYALRVPVITGSATDLTFNTKSEVTVESINAAIKEAAVGEFGETLAYSEEPLVSTDIVHDSHGSIFDAGLTKVSGNTVKVVSWYDNEWGYTCQLLRLTELVASKL

SEQ ID NO: 295 - DNA, 1005 bp, Artificial Sequence
  GapAv9-L224S (331772)
atgaccattcgtgttggtattaacggatttggccgtatcggacgtaacttcttccgcgcaattctggagcgcagcgacgatctcgaggtagttgcagtcaacggcaccaaggacaacaagaccctttccacccttctcaagttcgactccatcatgggccgccttggccaggaagttgaatacgacgatgactccatcaccgttggtggcaagcgcatcgctgtttacgcagagcgcgatccaaagaacctggactgggctgcacacaacgttgacatcgtgatcgagtccaccggcttcttcaccgatgcaaacgcggctaaggctcacatcgaagcaggtgccaagaaggtcatcatctccgcaccagcaagcaacgaagacgcaaccttcgtttacggtgtgaaccacgagtcctacgatcctgagaaccacaacgtgatctccggcgcatcttgcaccaccaactgcctcgcaccaatggcaaaggtcctgaacgacaagttcggcatcgagaacggtctcatgaccaccgttcacgcatacaccggcgaccagcgcctgcacgatgcaagccaccgcgacctgcgtcgtgcacgtgcagcagcagtcaacatcgttcctacctccaccggtgcagctaaggctgttgctctggttctcccagagagcaagggcaagcttgacggctacgcacttcgcgttccagttatcaccggttccgcaaccgacctgaccttcaacaccaagtctgaggtcaccgttgagtccatcaacgctgcaatcaaggaagctgcagtcggcgagttcggcgagaccctggcttactccgaagagccactggtttccaccgacatcgtccacgattcccacggctccatcttcgacgctggcctgaccaaggtctccggcaacaccgtcaaggttgtttcctggtacgacaacgagtggggctacacctgccagctcctgcgtctgaccgagctcgtagcttccaagctctaa

SEQ ID NO: 296 - protein, 334 aa, Artificial Sequence
  GapAv9-H110D (331828)
MTIRVGINGFGRIGRNFFRAILERSDDLEVVAVNGTKDNKTLSTLLKFDSIMGRLGQEVEYDDDSITVGGKRIAVYAERDPKNLDWAAHNVDIVIESTGFFTDANAAKADIEAGAKKVIISAPASNEDATFVYGVNHESYDPENHNVISGASCTTNCLAPMAKVLNDKFGIENGLMTTVHAYTGDQRLHDASHRDLRRARAAAVNIVPTSTGAAKAVALVLPELKGKLDGYALRVPVITGSATDLTFNTKSEVTVESINAAIKEAAVGEFGETLAYSEEPLVSTDIVHDSHGSIFDAGLTKVSGNTVKVVSWYDNEWGYTCQLLRLTELVASKL

SEQ ID NO: 297 - DNA, 1005 bp, Artificial Sequence
  GapAv9-H110D (331828)
atgaccattcgtgttggtattaacggatttggccgtatcggacgtaacttcttccgcgcaattctggagcgcagcgacgatctcgaggtagttgcagtcaacggcaccaaggacaacaagaccctttccacccttctcaagttcgactccatcatgggccgccttggccaggaagttgaatacgacgatgactccatcaccgttggtggcaagcgcatcgctgtttacgcagagcgcgatccaaagaacctggactgggctgcacacaacgttgacatcgtgatcgagtccaccggcttcttcaccgatgcaaacgcggctaaggctgacatcgaagcaggtgccaagaaggtcatcatctccgcaccagcaagcaacgaagacgcaaccttcgtttacggtgtgaaccacgagtcctacgatcctgagaaccacaacgtgatctccggcgcatcttgcaccaccaactgcctcgcaccaatggcaaaggtcctgaacgacaagttcggcatcgagaacggtctcatgaccaccgttcacgcatacaccggcgaccagcgcctgcacgatgcaagccaccgcgacctgcgtcgtgcacgtgcagcagcagtcaacatcgttcctacctccaccggtgcagctaaggctgttgctctggttctcccagagctcaagggcaagcttgacggctacgcacttcgcgttccagttatcaccggttccgcaaccgacctgaccttcaacaccaagtctgaggtcaccgttgagtccatcaacgctgcaatcaaggaagctgcagtcggcgagttcggcgagaccctggcttactccgaagagccactggtttccaccgacatcgtccacgattcccacggctccatcttcgacgctggcctgaccaaggtctccggcaacaccgtcaaggttgtttcctggtacgacaacgagtggggctacacctgccagctcctgcgtctgaccgagctcgtagcttccaagctctaa

SEQ ID NO: 298 - protein, 334 aa, Artificial Sequence
  GapAv9-K37P (331009)
MTIRVGINGFGRIGRNFFRAILERSDDLEVVAVNGTPDNKTLSTLLKFDSIMGRLGQEVEYDDDSITVGGKRIAVYAERDPKNLDWAAHNVDIVIESTGFFTDANAAKAHIEAGAKKVIISAPASNEDATFVYGVNHESYDPENHNVISGASCTTNCLAPMAKVLNDKFGIENGLMTTVHAYTGDQRLHDASHRDLRRARAAAVNIVPTSTGAAKAVALVLPELKGKLDGYALRVPVITGSATDLTFNTKSEVTVESINAAIKEAAVGEFGETLAYSEEPLVSTDIVHDSHGSIFDAGLTKVSGNTVKVVSWYDNEWGYTCQLLRLTELVASKL

SEQ ID NO: 299 - DNA, 1005 bp, Artificial Sequence
  GapAv9-K37P (331009)
atgaccattcgtgttggtattaacggatttggccgtatcggacgtaacttcttccgcgcaattctggagcgcagcgacgatctcgaggtagttgcagtcaacggcaccccggacaacaagaccctttccacccttctcaagttcgactccatcatgggccgccttggccaggaagttgaatacgacgatgactccatcaccgttggtggcaagcgcatcgctgtttacgcagagcgcgatccaaagaacctggactgggctgcacacaacgttgacatcgtgatcgagtccaccggcttcttcaccgatgcaaacgcggctaaggctcacatcgaagcaggtgccaagaaggtcatcatctccgcaccagcaagcaacgaagacgcaaccttcgtttacggtgtgaaccacgagtcctacgatcctgagaaccacaacgtgatctccggcgcatcttgcaccaccaactgcctcgcaccaatggcaaaggtcctgaacgacaagttcggcatcgagaacggtctcatgaccaccgttcacgcatacaccggcgaccagcgcctgcacgatgcaagccaccgcgacctgcgtcgtgcacgtgcagcagcagtcaacatcgttcctacctccaccggtgcagctaaggctgttgctctggttctcccagagctcaagggcaagcttgacggctacgcacttcgcgttccagttatcaccggttccgcaaccgacctgaccttcaacaccaagtctgaggtcaccgttgagtccatcaacgctgcaatcaaggaagctgcagtcggcgagttcggcgagaccctggcttactccgaagagccactggtttccaccgacatcgtccacgattcccacggctccatcttcgacgctggcctgaccaaggtctccggcaacaccgtcaaggttgtttcctggtacgacaacgagtggggctacacctgccagctcctgcgtctgaccgagctcgtagcttccaagctctaa

SEQ ID NO: 300 - protein, 334 aa, Artificial Sequence
  GapAv9-Y140G (331005)
MTIRVGINGFGRIGRNFFRAILERSDDLEVVAVNGTKDNKTLSTLLKFDSIMGRLGQEVEYDDDSITVGGKRIAVYAERDPKNLDWAAHNVDIVIESTGFFTDANAAKAHIEAGAKKVIISAPASNEDATFVYGVNHESGDPENHNVISGASCTTNCLAPMAKVLNDKFGIENGLMTTVHAYTGDQRLHDASHRDLRRARAAAVNIVPTSTGAAKAVALVLPELKGKLDGYALRVPVITGSATDLTFNTKSEVTVESINAAIKEAAVGEFGETLAYSEEPLVSTDIVHDSHGSIFDAGLTKVSGNTVKVVSWYDNEWGYTCQLLRLTELVASKL

SEQ ID NO: 301 - DNA, 1005 bp, Artificial Sequence
  GapAv9-Y140G (331005)
atgaccattcgtgttggtattaacggatttggccgtatcggacgtaacttcttccgcgcaattctggagcgcagcgacgatctcgaggtagttgcagtcaacggcaccaaggacaacaagaccctttccacccttctcaagttcgactccatcatgggccgccttggccaggaagttgaatacgacgatgactccatcaccgttggtggcaagcgcatcgctgtttacgcagagcgcgatccaaagaacctggactgggctgcacacaacgttgacatcgtgatcgagtccaccggcttcttcaccgatgcaaacgcggctaaggctcacatcgaagcaggtgccaagaaggtcatcatctccgcaccagcaagcaacgaagacgcaaccttcgtttacggtgtgaaccacgagtccggcgatcctgagaaccacaacgtgatctccggcgcatcttgcaccaccaactgcctcgcaccaatggcaaaggtcctgaacgacaagttcggcatcgagaacggtctcatgaccaccgttcacgcatacaccggcgaccagcgcctgcacgatgcaagccaccgcgacctgcgtcgtgcacgtgcagcagcagtcaacatcgttcctacctccaccggtgcagctaaggctgttgctctggttctcccagagctcaagggcaagcttgacggctacgcacttcgcgttccagttatcaccggttccgcaaccgacctgaccttcaacaccaagtctgaggtcaccgttgagtccatcaacgctgcaatcaaggaagctgcagtcggcgagttcggcgagaccctggcttactccgaagagccactggtttccaccgacatcgtccacgattcccacggctccatcttcgacgctggcctgaccaaggtctccggcaacaccgtcaaggttgtttcctggtacgacaacgagtggggctacacctgccagctcctgcgtctgaccgagctcgtagcttccaagctctaa

SEQ ID NO: 302 - protein, 334 aa, Artificial Sequence
  gapAv9 from Corynebacterium glutamicum
MTIRVGINGFGRIGRNFFRAILERSDDLEVVAVNGTKDNKTLSTLLKFDSIMGRLGQEVEYDDDSITVGGKRIAVYAERDPKNLDWAAHNVDIVIESTGFFTDANAAKAHIEAGAKKVIISAPASNEDATFVYGVNHESYDPENHNVISGASCTTNCLAPMAKVLNDKFGIENGLMTTVHAYTGDQRLHDASHRDLRRARAAAVNIVPTSTGAAKAVALVLPELKGKLDGYALRVPVITGSATDLTFNTKSEVTVESINAAIKEAAVGEFGETLAYSEEPLVSTDIVHDSHGSIFDAGLTKVSGNTVKVVSWYDNEWGYTCQLLRLTELVASKL

SEQ ID NO: 303 - DNA, 1005 bp, Artificial Sequence
  gapAv9 from Corynebacterium glutamicum
atgaccattcgtgttggtattaacggatttggccgtatcggacgtaacttcttccgcgcaattctggagcgcagcgacgatctcgaggtagttgcagtcaacggcaccaaggacaacaagaccctttccacccttctcaagttcgactccatcatgggccgccttggccaggaagttgaatacgacgatgactccatcaccgttggtggcaagcgcatcgctgtttacgcagagcgcgatccaaagaacctggactgggctgcacacaacgttgacatcgtgatcgagtccaccggcttcttcaccgatgcaaacgcggctaaggctcacatcgaagcaggtgccaagaaggtcatcatctccgcaccagcaagcaacgaagacgcaaccttcgtttacggtgtgaaccacgagtcctacgatcctgagaaccacaacgtgatctccggcgcatcttgcaccaccaactgcctcgcaccaatggcaaaggtcctgaacgacaagttcggcatcgagaacggtctcatgaccaccgttcacgcatacaccggcgaccagcgcctgcacgatgcaagccaccgcgacctgcgtcgtgcacgtgcagcagcagtcaacatcgttcctacctccaccggtgcagctaaggctgttgctctggttctcccagagctcaagggcaagcttgacggctacgcacttcgcgttccagttatcaccggttccgcaaccgacctgaccttcaacaccaagtctgaggtcaccgttgagtccatcaacgctgcaatcaaggaagctgcagtcggcgagttcggcgagaccctggcttactccgaagagccactggtttccaccgacatcgtccacgattcccacggctccatcttcgacgctggcctgaccaaggtctccggcaacaccgtcaaggttgtttcctggtacgacaacgagtggggctacacctgccagctcctgcgtctgaccgagctcgtagcttccaagctctaa

SEQ ID NO: 304 - DNA, 1266 bp, Corynebacterium glutamicum; identical to SEQ ID NO: 49

SEQ ID NO: 305 - protein, 421 aa, Corynebacterium glutamicum; identical to SEQ ID NO: 50

SEQ ID NO: 306 - DNA, 14 bp, Artificial Sequence
  Artificial ribosome binding site
agctggtggaatat

SEQ ID NO: 307 - DNA, 10 bp, Artificial Sequence
  Artificial ribosome binding site
aggaggttgt

SEQ ID NO: 308 - DNA, 12 bp, Artificial Sequence
  Artificial ribosome binding site
tgacacctattg

What is claimed is:

1. A method of improving a microbial cell's ability to produce L-lysine, the method comprising altering the microbial cell's available NADPH by genetically modifying the microbial cell to express:
   a) an aldehyde dehydrogenase from *Lactobacillus agilis* comprising SEQ ID NO: 30 or an aspartate-semi-aldehyde dehydrogenase from *C. glutamicum* comprising SEQ ID NO:40;
   b) an glutamate dehydrogenase from *Clostridium symbiosum* comprising SEQ ID NO: 44;
   c) a 4-hydroxy-tetrahydrodipicolinate reductase from *Escherichia coli* comprising SEQ ID NO: 48; and
   d) a meso-diaminopimelate D-dehydrogenase from *C. glutamicum* comprising SEQ ID NO: 4,
wherein the microbial cell produces at least 40% more L-Lysine than a microbial cell that does not contain a)-d).

2. The method of claim 1, wherein the microbial cell is a microbial cell selected from the group consisting of *Corynebacterium* cell, *Escherichia* cell, *Bacillus* cell and *Geobacillus* cell.

3. The method of claim 1, wherein the microbial cell is a *Corynebacterium glutamicum* cell or an *Escherichia coli* cell.

4. The method of claim 1, wherein the bacteria is *E. coli* and the method further comprises expressing a pyruvate carboxylase (pyc) in the *E. coli* cell.

5. The method of claim 1, wherein the microbial cell is a *Corynebacterium* cell.

6. The method of claim 1, wherein the microbial cell is an *Escherichia* cell.

7. The method of claim 1, herein the microbial cell is a *Bacillus* cell.

8. The method of claim 1, wherein the microbial cell is a *Geobacillus* cell.

9. The method of claim 1, wherein the method comprises altering the microbial cell's available NADPH by genetically modifying the microbial cell to express:
   a) an aldehyde dehydrogenase *Lactobacillus agilis* comprising SEQ ID NO: 30;
   b) an glutamate dehydrogenase from *Clostridium symbiosum* comprising SEQ ID NO: 44;
   c) a 4-hydroxy-tetrahydrodipicolinate reductase from *Escherichia coli* comprising SEQ ID NO: 48; and
   d) a meso-diaminopimelate D-dehydrogenase from *C. glutamicum* comprising SEQ ID NO: 4.

10. The method of claim 9, wherein the microbial cell is a *Corynebacterium* cell.

11. The method of claim 1, wherein the method comprises altering the microbial cell's available NADPH by genetically modifying the microbial cell to express:
   a) an aspartate-semi-aldehyde dehydrogenase from *C. glutamicum* comprising SEQ ID NO:40;
   b) an glutamate dehydrogenase from *Clostridium symbiosum* comprising SEQ ID NO: 44;
   c) a 4-hydroxy-tetrahydrodipicolinate reductase from *Escherichia coli* comprising SEQ ID NO: 48; and
   d) a meso-diaminopimelate D-dehydrogenase from *C. glutamicum* comprising SEQ ID NO: 4.

12. The method of claim 11, wherein the microbial cell is a *Corynebacterium* cell.

* * * * *

UNITED STATES PATENT AND TRADEMARK OFFICE
CERTIFICATE OF CORRECTION

PATENT NO. : 11,519,012 B2
APPLICATION NO. : 16/614566
DATED : December 6, 2022
INVENTOR(S) : Shawn Manchester et al.

Page 1 of 1

It is certified that error appears in the above-identified patent and that said Letters Patent is hereby corrected as shown below:

In the Claims

At Column 118, Claim number 7, Line number 14:
"The method of claim 1, herein the microbial cell is a"
Should read:
-- The method of claim 1, wherein the microbial cell is a --

At Column 118, Claim number 9, Line number 21:
"a) an aldehyde dehydrogenase *Lactobacillus agilis* com- --"
Should read:
-- a) an aldehyde dehydrogenase from *Lactobacillus agilis* com- --

Signed and Sealed this
Twenty-eighth Day of March, 2023

Katherine Kelly Vidal
*Director of the United States Patent and Trademark Office*